(12) United States Patent
Mazur et al.

(10) Patent No.: US 10,344,268 B2
(45) Date of Patent: Jul. 9, 2019

(54) POLYMERASE COMPOSITIONS AND KITS, AND METHODS OF USING AND MAKING THE SAME

(71) Applicant: LIFE TECHNOLOGIES CORPORATION, Carlsbad, CA (US)

(72) Inventors: Daniel Mazur, San Diego, CA (US); Peter Vander Horn, Encinitas, CA (US); Eileen Tozer, San Diego, CA (US); Sihong Chen, Vista, CA (US); Guobin Luo, Oceanside, CA (US); Joshua Shirley, Carlsbad, CA (US); Kevin Heinemann, Carlsbad, CA (US)

(73) Assignee: LIFE TECHNOLOGIES CORPORATION, Carlsbad, CA (US)

( * ) Notice: Subject to any disclaimer, the term of this patent is extended or adjusted under 35 U.S.C. 154(b) by 0 days.

(21) Appl. No.: 15/277,834

(22) Filed: Sep. 27, 2016

(65) Prior Publication Data

US 2017/0096648 A1    Apr. 6, 2017

Related U.S. Application Data

(60) Provisional application No. 62/235,616, filed on Oct. 1, 2015.

(51) Int. Cl.
*C12N 9/12* (2006.01)
*C12Q 1/686* (2018.01)

(52) U.S. Cl.
CPC ........... *C12N 9/1252* (2013.01); *C12Q 1/686* (2013.01); *C12Y 207/07007* (2013.01)

(58) Field of Classification Search
None
See application file for complete search history.

(56) References Cited

U.S. PATENT DOCUMENTS

| | | |
|---|---|---|
| 2011/0262903 A1 | 10/2011 | Davidson et al. |
| 2011/0301041 A1 | 12/2011 | Davidson et al. |
| 2011/0318748 A1 | 12/2011 | Davidson et al. |
| 2012/0202276 A1 | 8/2012 | Davidson et al. |
| 2015/0094211 A1 | 4/2015 | Vander Horn et al. |
| 2015/0280880 A1 | 10/2015 | Yang et al. |
| 2015/0368626 A1 | 12/2015 | Vander Horn et al. |
| 2016/0177373 A1 | 6/2016 | Mazur et al. |

FOREIGN PATENT DOCUMENTS

| | | |
|---|---|---|
| WO | WO-2011/106629 | 9/2011 |
| WO | WO-2013/023176 | 2/2013 |

OTHER PUBLICATIONS

Ngo et al. In the Protein Folding Problem and Tertiary Structure Prediction, 1994, Merz et al. (ed.), Birkhauser, Boston, MA, pp. 433 and 492-495.*
PCT/US2016/053994, International Search Report dated May 26, 2017, 6 Pages.

* cited by examiner

*Primary Examiner* — Richard G Hutson
(74) *Attorney, Agent, or Firm* — Life Technologies Corporation; Karen R. Zachow; Paula Kay Schoeneck

(57) ABSTRACT

The present disclosure provides compositions, methods, kits, systems and apparatus that are useful for nucleic acid polymerization. In particular, recombinant polymerases and biologically active fragments thereof are provided that allow for nucleic acid amplification. In some aspects, the disclosure provides recombinant polymerases that yield lower systematic error rates and/or improved accuracy, when used in sequencing by synthesis reactions as compared to a control polymerase. In one aspect, the disclosure relates to recombinant polymerases useful for nucleic acid sequencing, genotyping, copy number variation analysis, paired-end sequencing and other forms of genetic analysis. In another aspect, the recombinant polymerases are useful for the amplification of nucleic acid templates during PCR, emPCR, isothermal amplification, recombinase polymerase amplification, rolling circle amplification, strand displacement amplification and proximity ligation amplification. In some aspects, the disclosure relates to recombinant polymerases useful for the generation of nucleic acid libraries and/or nucleic acid templates.

21 Claims, 9 Drawing Sheets

Specification includes a Sequence Listing.

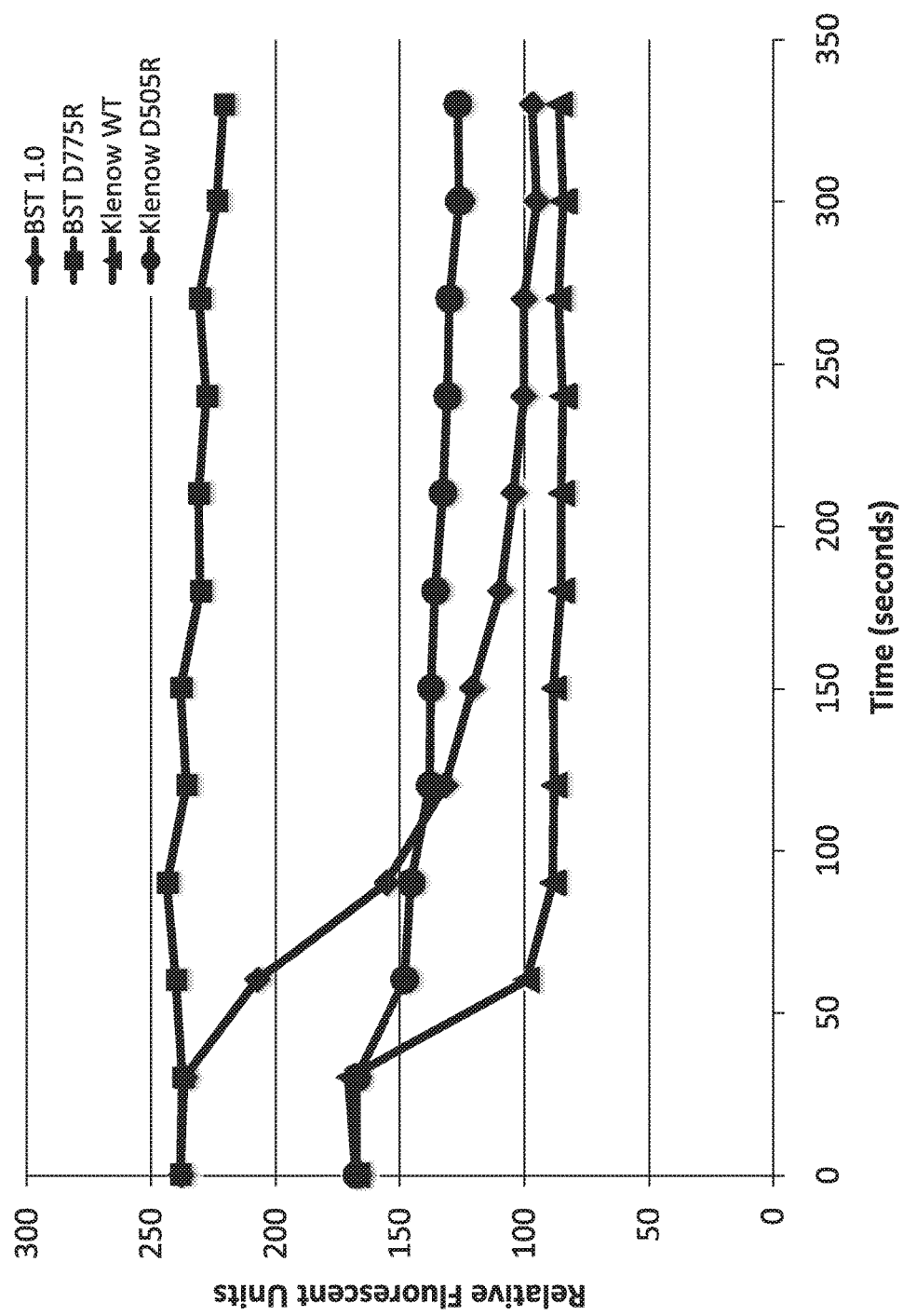

FIG. 3A

| Plate 1 AVE aq20 | | |
|---|---|---|
| Position | MRL | AVE SSE |
| V241K | 165.5 | 0.3435 |
| G209Q | 162.5 | 0.3355 |
| N234K | 160.5 | 0.348 |
| N234R | 161.5 | 0.3325 |
| P236I | 158.5 | 0.3395 |
| P236R | 160 | 0.307 |
| L252R | 158.5 | 0.335 |
| E220H | 162 | 0.3955 |
| E220K | 162.5 | 0.315 |
| E220T | 161.5 | 0.387 |
| S260K | 164.5 | 0.297 |
| T324R | 159 | 0.3945 |
| PSP4 | 141 | 0.484 |
| PSP4 | 135.5 | 0.985 |
| PSP4 | 150.5 | 0.4365 |
| PSP4 | 147 | 0.4825 |

FIG. 3B

| Plate 2 AVE aq20 | | |
|---|---|---|
| Position | MRL | AVE SSE |
| E267M | 166.5 | 0.2765 |
| E267K | 160.5 | 0.257 |
| E267R | 159.5 | 0.2485 |
| E277T | 161.5 | 0.286 |
| E294K | 160.5 | 0.259 |
| E456R | 166.5 | 0.3015 |
| E493G | 162 | 0.3115 |
| E493R | 163.5 | 0.2415 |
| PSP4 | 136 | 0.502 |
| PSP4 | 141.5 | 0.471 |
| PSP4 | 132.5 | 0.468 |

FIG. 3C

| Plate 3 AVE aq20 | | |
|---|---|---|
| Position | MRL | AVE SSE |
| E442R | 156.0 | 0.319 |
| E442Y | 158.5 | 0.3155 |
| M495C | 157 | 0.346 |
| E325R | 150 | 0.296 |
| A492K | 161 | 0.3115 |
| PSP4 | 139 | 0.522 |
| PSP4 | 139 | 0.524 |
| PSP4 | 137 | 0.485 |

FIG. 3D

| Plate 4 AVE aq20 | | |
|---|---|---|
| Position | MRL | AVE SSE |
| D480L | 152.5 | 0.483 |
| A344Y | 143.5 | 0.538 |
| D480R | 150.5 | 0.5235 |
| E245R | 151 | 0.556 |
| E30K | 148.5 | 0.495 |
| PSP4 | 116 | 0.703 |
| PSP4 | 126 | 0.705 |
| PSP4 | 113 | 0.776 |
| PSP4 | 112 | 0.6805 |

FIG. 3E

| Plate 5 AVE aq20 | | |
|---|---|---|
| Position | MRL | AVE SSE |
| N517C | 148 | 0.5855 |
| N517K | 151.5 | 0.487 |
| V251R | 147 | 0.4845 |
| PSP4 | 106.5 | 0.782 |
| PSP4 | 102 | 0.825 |
| PSP4 | 113.5 | 0.766 |
| PSP4 | 109.5 | 0.7025 |

FIG. 3F

| Plate 6 AVE aq20 | | |
|---|---|---|
| Position | MRL | AVE SSE |
| N485R | 144 | 0.5985 |
| E522C | 143 | 0.462 |
| D264K | 143.5 | 0.4685 |
| D264M | 139.5 | 0.664 |
| PSP4 | 99.3 | 0.918 |
| PSP4 | 89.7 | 1.582 |
| PSP4 | 98.0 | 0.898 |
| PSP4 | 97.5 | 0.8515 |

FIG. 4

| Key | PSP4 | | PSP4-252R | | PSP4-252R++ | |
|---|---|---|---|---|---|---|
| | Auto_user_C61-482-R203455-L8054_PSP4_140_KMT-etd_44087 | Auto_user_C62-466-R203454-L8054_PSP4_140_KMT-etd_44086 | Auto_user_C63-460-R203458-L8054_PSP4-547Rlot3 etd_44090 | Auto_user_C09-1126-R203459-L8054_PSP4-547Rlot3 etd_44091 | Auto_user_C58-467-R203461-L8054_PSP4-547R_823T-etd_44093 | Auto_user_C57-460-R203460-L8054_PSP4-547R_823T-etd_44092 |
| 1 | FIG. 4A | FIG. 4C | FIG. 4E | FIG. 4G | FIG. 4I | FIG. 4K |
| 2 | FIG. 4B | FIG. 4D | FIG. 4F | FIG. 4H | FIG. 4J | FIG. 4L |
| 3 | 355 | 373 | 408 | 426 | 451 | 442 |
| 4 | 99.45% | 99.51% | 99.55% | 99.61% | 99.11% | 99.68% |
| 5 | 0.958% | 0.807% | 0.740% | 0.633% | 0.477% | 0.522% |
| 6 | 76.0320 | 77.4615 | 78.4057 | 82.0864 | 88.8042 | 87.5204 |
| 7 | 67.1964 | 68.7622 | 70.5849 | 73.0959 | 80.5484 | 79.2090 |

Row: 1: AQ20 Read Lengths, 2: Perfect Read Lengths, 3: Mean length: AQ20 (bp), 4: Average Raw Read Accuracy, 5: Error Percentage @ 400bp, 6: True accuracy for homopolymer ACGT 6bp, 7: True accuracy for homopolymer ACGT 7bp

FIG. 5

| Enzyme | runname | bases (aq20) | peak signal | Readlength (q20) | Raw Read Accuracy (%) |
|---|---|---|---|---|---|
| PSP4+L252R+H528T+H473G | SN1-121 | 300,212,162 | 65 | 408 | 99.6 |
| PSP4+L252R+H528T+H473G | C09-1190 | 323,047,812 | 65 | 427 | 99.7 |
| PSP4+L252R+H528T | C08-340 | 211,639,578 | 62 | 408 | 99.6 |
| PSP4+L252R+H528T | C07-58 | 271,046,206 | 61 | 406 | 99.6 |
| PSP4+L252R | C06-374 | 267,676,163 | 56 | 405 | 99.6 |
| PSP4+L252R | SN1-7 | 251,361,169 | 55 | 380 | 99.5 |

POLYMERASE COMPOSITIONS AND KITS, AND METHODS OF USING AND MAKING THE SAME

CROSS-REFERENCE TO RELATED APPLICATIONS

This application claims benefit of U.S. Provisional Application Ser. No. 62/235,616, filed Oct. 1, 2015. This application is incorporated by reference in its entirety.

SEQUENCE LISTING

This application hereby incorporates by reference the material of the electronic Sequencing Listing filed concurrently herewith. The materials in the electronic Sequence Listing is submitted as a text (.txt) file entitled "LT01102_SeqList_092316.txt" created on Dec. 2, 2016, which has a file size of 696,913 bytes, and is herein incorporated by reference in its entirety.

FIELD OF INVENTION

Provided are modified DNA polymerases and compositions and kits, and methods of using and making the same.

BACKGROUND

The ability of enzymes to catalyze biological reactions is fundamental to life. A range of biological applications use enzymes to synthesize various biomolecules in vitro. One particularly useful class of enzymes is the polymerases, which can catalyze the polymerization of biomolecules (e.g., nucleotides or amino acids) into biopolymers (e.g., nucleic acids or peptides). For example, polymerases that can polymerize nucleotides into nucleic acids, particularly in a template-dependent fashion, are useful in recombinant DNA technology and nucleic acid sequencing applications. Many nucleic acid sequencing methods monitor nucleotide incorporations during in vitro template-dependent nucleic acid synthesis catalyzed by a polymerase. Single Molecule Sequencing (SMS) and Paired-End Sequencing (PES) typically include a polymerase for template-dependent nucleic acid synthesis. Polymerases are also useful for the generation of nucleic acid libraries, such as libraries created during emulsion PCR or bridge PCR. Nucleic acid libraries created using such polymerases can be used in a variety of downstream processes, such as genotyping, nucleotide polymorphism (SNP) analysis, copy number variation analysis, epigenetic analysis, gene expression analysis, hybridization arrays, analysis of gene mutations including but not limited to detection, prognosis and/or diagnosis of disease states, detection and analysis of rare or low frequency allele mutations, and nucleic acid sequencing including but not limited to de novo sequencing or targeted resequencing.

When performing polymerase-dependent nucleic acid synthesis or amplification, it can be useful to modify the polymerase (for example via mutation or chemical modification) so as to alter its catalytic properties. In some instances, it can be useful to modify the polymerase to enhance its catalytic properties. In some embodiments, it can be useful to enhance a polymerase's catalytic properties via site-directed amino acid substitution or deletion. Polymerase performance in various biological assays involving nucleic acid synthesis can be limited by the kinetic behavior of the polymerase towards nucleotide substrates. For example, analysis of polymerase activity can be complicated by undesirable behavior such as the tendency of a given polymerase to dissociate from the template; to bind and/or incorporate the incorrect, e.g., non-Watson-Crick base-paired, nucleotide; or to release the correct, e.g., Watson-Crick based paired, nucleotide without incorporation. These and other desirable properties can be enhanced via suitable selection, engineering and/or modification of a polymerase of choice. For example, such modification can be performed to favorably alter a polymerase's rate of nucleotide incorporation, affinity of binding to template, processivity, average read length, accuracy of nucleotide incorporation, strand bias, systematic error, and/or total sequencing throughput; such alterations can increase the amount of sequence information and/or quality of sequencing information obtained from a single sequencing reaction. There remains a need in the art for improved polymerase compositions exhibiting altered properties, e.g., increased processivity, increased read length (including error-free read length), increased raw accuracy and/or affinity for DNA template, increased sequencing throughput, decreased strand bias and/or decreased systematic error. Such polymerase compositions can be useful in a wide variety of assays involving polymerase-dependent nucleic acid synthesis, including nucleic acid sequencing, qPCR, PCR, bridge PCR, isothermal amplification, clonal amplification and production of nucleic acid libraries.

SUMMARY

The disclosure relates generally to non-naturally occurring mutant, typically recombinant, Bst polymerases and compositions, kits, and methods of using and making the same. The mutant, (e.g. recombinant) Bst polymerases contain at least one amino acid mutation (e.g., substitution, deletion or addition) as compared to a reference (e.g. wild type) Bst polymerase and have improved properties. In some embodiments, the mutant (e.g. recombinant) Bst DNA polymerases have lowered systematic error, increased signal to noise ratio, and/or improved accuracy in a sequencing by synthesis reaction, especially a sequencing by synthesis reaction that uses the mutant Bst polymerase in a step wherein hydrogen ions are generated and/or detected, as compared to a wild type and/or reference mutant Bst DNA polymerase. Furthermore, provided herein are methods for performing a polymerization reaction that include contacting a mutant (e.g. recombinant) Bst DNA polymerase, or a biologically active fragment thereof, provided herein, with a nucleic acid template in the presence of one or more nucleotides, and polymerizing at least one of the one or more nucleotides using the mutant polymerase or the biologically active fragment thereof.

Accordingly, the present invention in illustrative embodiments provides a non-naturally occurring mutant DNA polymerase that is typically a recombinant DNA polymerase, as well as compositions, kits, and methods that include the mutant (e.g. recombinant) DNA polymerase, wherein the polymerase has a polypeptide segment having at least 80%, 85%, 90%, 95%, 96%, 97%, 98%, or 99% sequence identity to SEQ ID NO: 1 or a fragment thereof, exhibits polymerase activity, and includes either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325A, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T. The mutant (e.g. recombinant) DNA polymerase can yield a lower error rate (e.g. average systematic error rate), improved accuracy, and/or an increased signal to noise ratio, when used in a sequencing by synthesis reaction wherein hydrogen ions are released and/or detected, as compared to an error rate, accuracy, and/or signal to noise ratio obtained using a reference Bst polymerase, such as wild-type Bst polymerase, the mutant Bst polymerase of SEQ ID NO: 2, or the mutant Bst polymerase of SEQ ID NO: 35. The sequencing by synthesis reaction in which the polymerase has improved properties in illustrative examples, is a sequencing reaction in which hydrogen ions are released and detected. The mutant (e.g. recombinant) polymerase in illustrative embodiments include amino acid substitutions H46R, E446Q, and H572R, and/or can include mutations H281M, D423K, and N487R, wherein the numbering is relative to SEQ ID NO: 1. In illustrative embodiments, the mutant (e.g. recombinant) polymerase does not have 5' to 3' exonuclease activity and/or 3' to 5' exonuclease activity. In illustrative embodiments, the mutant (e.g. recombinant) polymerase does not comprise segments of wild type Bst DNA polymerase having 3' to 5'exonuclease activity and/or 5' to 3' exonuclease activity The mutant (e.g. recombinant) DNA polymerase in illustrative embodiments include one or more of L252R, H473G, and H528T, wherein the numbering is relative to SEQ ID NO: 1). Accordingly, in certain examples provided herein, the mutant (e.g. recombinant) DNA polymerase has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes any one or two of L252R, H473G, and H528T, or includes all of L252R, H473G, and H528T, wherein the numbering is relative to SEQ ID NO: 1. In an exemplary embodiment having such mutations, the non-naturally occurring mutant has the sequence of SEQ ID NO: 119.

In further subembodiments, the polypeptide segment of the mutant (e.g. recombinant) DNA polymerase in the embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or at least 75%, 80%, 85%, 90%, 95%, 96%, 97%, 98%, or 99% identity to SEQ ID NO: 16, which is full length wild-type Bst polymerase. The mutant (e.g. recombinant) DNA polymerase in such subembodiments exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary embodiment having such mutations, the mutant DNA Polymerase has the amino acid sequence of SEQ ID NO: 121.

In another aspect of the invention, a method for performing a polymerization reaction is provided, that includes the following: (a) contacting a non-naturally occurring mutant (e.g. recombinant) DNA polymerase with a nucleic acid in the presence of one or more nucleotides; and (b) polymerizing at least one of the one or more nucleotides using the mutant (e.g. recombinant) DNA polymerase. The mutant (e.g. recombinant) DNA polymerase in such a method can include a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R, and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The recombinant polymerase used in such a method, can have the property, in illustrative embodiments, of yielding a lower systematic error rate, increased signal to noise ratio, and/or higher accuracy, when used in a sequencing by synthesis reaction as compared to a reference polymerase. The sequencing by synthesis reaction in illustrative examples is a reaction in which hydrogen ions are generated and detected. The mutant (e.g. recombinant) polymerase used in the method in illustrative embodiments, includes amino acid substitutions H46R, E446Q, and H572R, and/or can include mutations H281M, D423K, and N487R, wherein the numbering is relative to SEQ ID NO: 1. Salt can be included in a reaction mixture in which the contacting occurs. The reaction mixture can include the salt, for example at a concentration of between 50 and 250 mM, or between 100 mM and 200 mM, or between 120 and 200 mM, or in excess of 120 mM, such as between 125 mM and 250 mM, or between 125 mM and 175 mM. The salt in illustrative examples is KCl and/or NaCl.

The mutant (e.g. recombinant) DNA polymerase in the method for performing a polymerization reaction provided above, in illustrative examples, includes one or more of L252R, H473G, and H528T, wherein the numbering is relative to SEQ ID NO: 1. Accordingly, in certain illustrative examples, provided herein the mutant (e.g. recombinant) DNA polymerase used in the method for performing a polymerization reaction has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T wherein the numbering is relative to SEQ ID NO: 1. In an exemplary embodiment having such mutations, the non-naturally occurring mutant (e.g. recombinant) DNA polymerase has the sequence of SEQ ID NO: 119.

In further subembodiments, the polypeptide segment of the mutant (e.g. recombinant) DNA polymerase in the method for polymerizing embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or SEQ ID NO: 16, which is full length wild-type Bst polymerase. The mutant (e.g. recombinant) DNA polymerase in such methods for polymerizing subembodiments, exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain illustrative embodiments, the mutant (e.g. recombinant) DNA polymerase includes L547R, H768G, and H823T. In illustrative embodiments, the mutant (e.g. recombinant) polymerase does not have 5' to 3' exonuclease activity and/or 3' to 5' exonuclease activity. In an exemplary method for polymerizing embodiment wherein the mutant (e.g. recombinant) DNA polymerase has such mutations, the mutant DNA Polymerase has the amino acid sequence of SEQ ID NO: 121.

In another aspect of the invention, a method for amplifying a nucleic acid is provided, that includes the following: (a) contacting a nucleic acid in the presence of one or more nucleotides, with a non-naturally occurring mutant (e.g. recombinant) DNA polymerase that includes a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The mutant (e.g. recombinant) polymerase used in such a method, has the property in illustrative embodiments, of yielding a lower systematic error rate and/or higher accuracy, when used in a sequencing by synthesis reaction as compared to a reference polymerase. The sequencing by synthesis reaction in illustrative examples is a reaction in which hydrogen ions are generated and detected. The mutant (e.g. recombinant) polymerase used in the method in illustrative examples, includes amino acid substitutions H46R, E446Q, and H572R, and/or can include mutations H281M, D423K, and N487R, wherein the numbering is relative to SEQ ID NO: 1. Salt can be included in a reaction mixture in which the contacting occurs. The reaction mixture can include a salt, for example at a concentration of between 50 and 250 mM, or between 100 mM and 200 mM, or between 120 mM to 200 mM, or between 120 and 200 mM, or in excess of 120 mM, such as between 125 mM and 250 mM, or between 125 mM and 175 mM. The salt in illustrative examples, is KCl and/or NaCl.

The mutant (e.g. recombinant) DNA polymerase in the method for amplifying a nucleic acid provided above, in illustrative examples includes one or more of L252R, H473G. and H528T, wherein the numbering is relative to SEQ ID NO: 1. Accordingly, in certain examples, provided herein the mutant DNA polymerase in the recombinant DNA polymerase and related embodiments has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T wherein the numbering is relative to SEQ ID NO: 1. In an exemplary embodiment having such mutations, the non-naturally occurring mutant has the sequence of SEQ ID NO: 119.

In further subembodiments, the polypeptide segment of the mutant (e.g. recombinant) DNA polymerase in the method for amplifying embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or SEQ ID NO: 16, which is full length wild-type Bst polymerase. The mutant (e.g. recombinant) DNA polymerase in such subembodiments exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary embodiment having such mutations, the mutant DNA Polymerase has the amino acid sequence of SEQ ID NO: 121.

In certain embodiments, the method of amplifying is a polymerase chain reaction, an emulsion polymerase chain reaction, an isothermal amplification reaction, a recombinase polymerase amplification reaction, a proximity ligation amplification reaction, a rolling circle amplification reaction or a strand displacement amplification reaction. In certain embodiments, the amplification is clonally amplifying the nucleic acid in solution or on a solid support.

In a further aspect of the invention, a method for obtaining sequence information from a nucleic acid template is provided, that includes the following: (a) providing a reaction mixture comprising a template nucleic acid, a sequencing primer, one or more nucleotides, and a non-naturally occurring mutant (e.g. recombinant) DNA polymerase; (b) contacting the template nucleic acid with at least one type of nucleotide, wherein the contacting includes incorporating one or more nucleotides from the at least one type of nucleotide onto the 3' end of the sequencing primer and generating an extended primer product using the mutant (e.g. recombinant) DNA polymerase; and (c) detecting the presence of the extended primer product in the reaction mixture, thereby determining whether nucleotide incorporation has occurred. The mutant (e.g. recombinant) DNA polymerase in such a method can include a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R, and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The recombinant polymerase used in such a method, can in illustrative embodiments, yield a lower systematic error rate and/or higher accuracy, when used in a sequencing by synthesis reaction as compared to a reference polymerase. The sequencing by synthesis reaction in illustrative examples is a reaction in which hydrogen ions are generated and detected. The reaction mixture can include a salt, for example at a concentration of between 50 and 250 mM, or between 100 mM and 200 mM, or between 120 and 200 mM, or in excess of 120 mM, such as between 125 mM and 250 mM, or between 125 mM and 175 mM. The salt in illustrative examples, is KCl and/or NaCl.

The mutant (e.g. recombinant) DNA polymerase in the method for obtaining sequence information from a nucleic acid template provided above, in illustrative examples, includes one or more of L252R, H473G. and H528T, wherein the numbering is relative to SEQ ID NO: 1. Accordingly, in certain examples, provided herein the mutant DNA polymerase in the recombinant DNA polymerase and related embodiments has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T, wherein the numbering is relative to SEQ ID NO: 1. In an exemplary embodiment of the method for obtaining sequence information, the mutant (e.g. recombinant) DNA polymerase having such mutations, has the sequence of SEQ ID NO: 119.

In further subembodiments of the method for obtaining sequence information from a nucleic acid template, the polypeptide segment of the mutant (e.g. recombinant) DNA polymerase in the embodiments provided above, can be at least 50%, 60%, 70%, 75%, 80%, 90%, 95%, 96%, 97%, 98%, 99% or 100% of the mutant (e.g. recombinant) DNA polymerase, and can have at least 75%, 80%, 85%, 90%, 95%, 96%, 97%, 98%, or 99% identity to SEQ ID NO: 1, or SEQ ID NO: 16, which is full length wild-type Bst polymerase. The mutant (e.g. recombinant) DNA polymerase in such subembodiments exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary of the method for obtaining sequence information, the mutant (e.g. recombinant) DNA polymerase having such mutations, has the amino acid sequence of SEQ ID NO: 121.

In the embodiments of the method at least one of the one or more nucleotides incorporated onto the 3' end of the sequencing primer is a reversible terminator nucleotide; the contacting includes generating one or more hydrogen ions as a by-product of nucleotide incorporation; the detecting includes measuring a concentration of one or more hydrogen ions generated as a by-product of nucleotide incorporation; and the method further includes identifying at least one of the one or more nucleotides incorporated from the at least one type of nucleotide. The method contacting, detecting and identifying steps are repeated more than once, thereby identifying a plurality of sequential nucleotide incorporations.

BRIEF DESCRIPTION OF THE DRAWINGS

The accompanying drawings, which are incorporated into and form a part of the specification, illustrate one or more exemplary embodiments and serve to explain the principles of various exemplary embodiments. The drawings are exemplary and explanatory only and are not to be construed as limiting or restrictive in any way.

FIG. 2 shows a graph outlining an exemplary dissociation rate curve for exemplary modified polymerases obtained according to the disclosure.

FIGS. 3A-3F are tables providing exemplary nucleic acid sequencing data obtained using exemplary recombinant polymerases according to the disclosure.

FIG. 5 is a table providing exemplary nucleic acid sequencing data obtained using three recombinant polymerases according to the disclosure.

DETAILED DESCRIPTION

Figure 1:
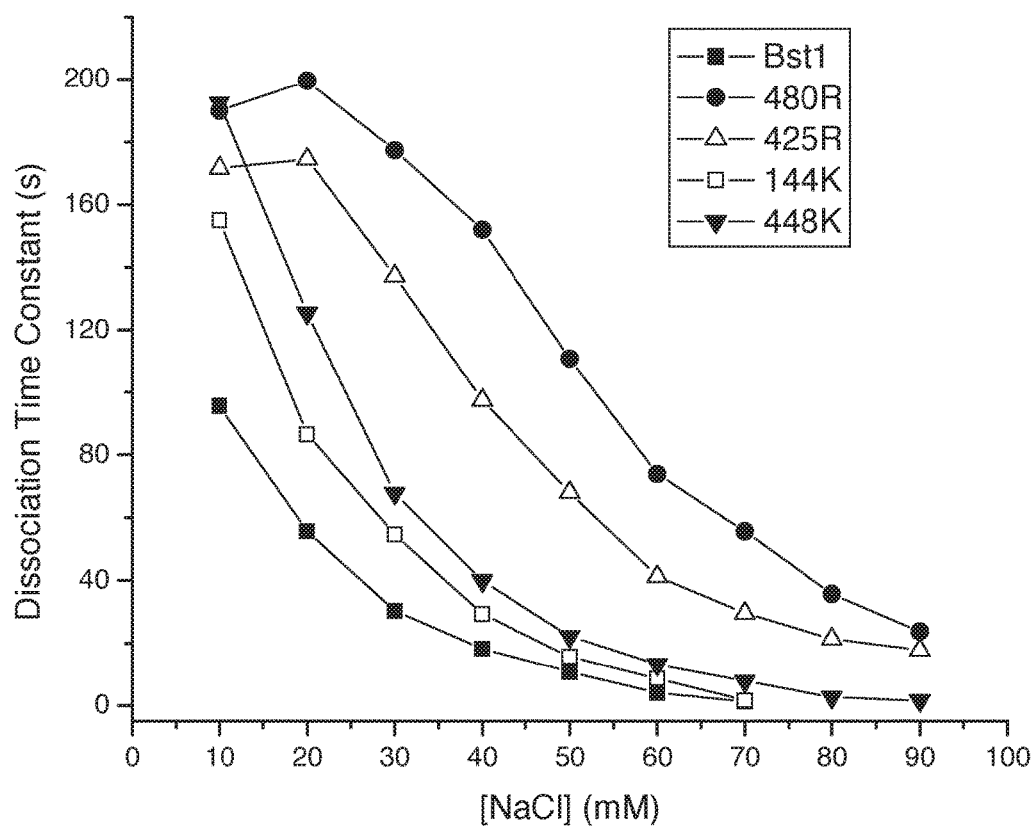
FIG. 1 shows a graph outlining an exemplary dissociation assay performed according to the disclosure.
Figure 4A:
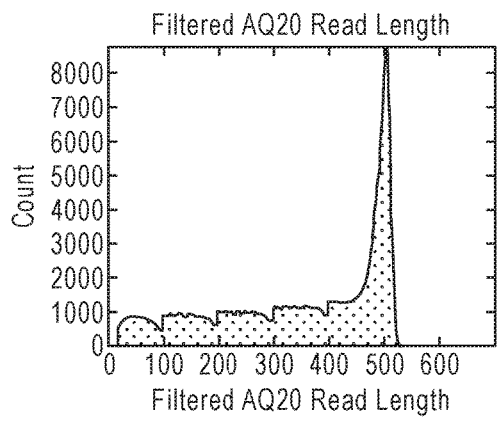
FIG. 4 is a table showing exemplary nucleic acid sequencing data obtained using three recombinant polymerases according to the disclosure. Included in the table in FIG. 4 are references to presentations of sequencing data in graph format which are provided as FIGS. 4A-4L.
Figure 4C:
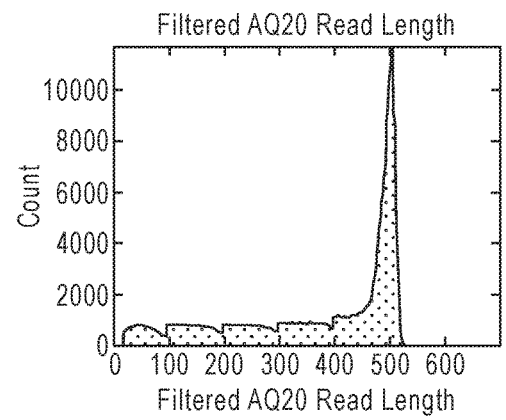
Figure 4B:
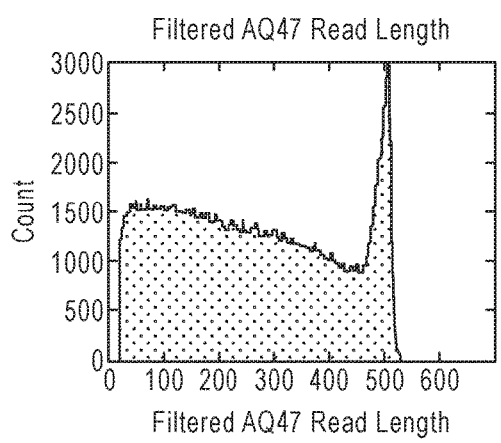
Figure 4D:
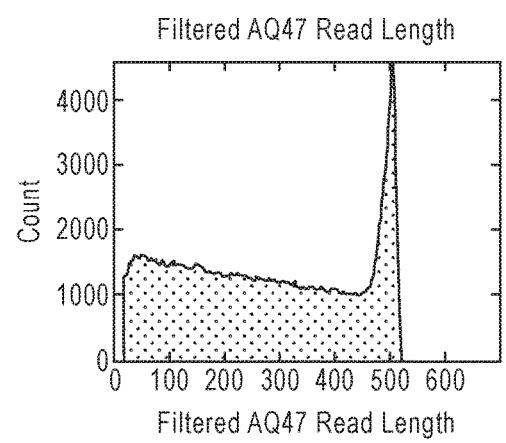
Figure 4E:
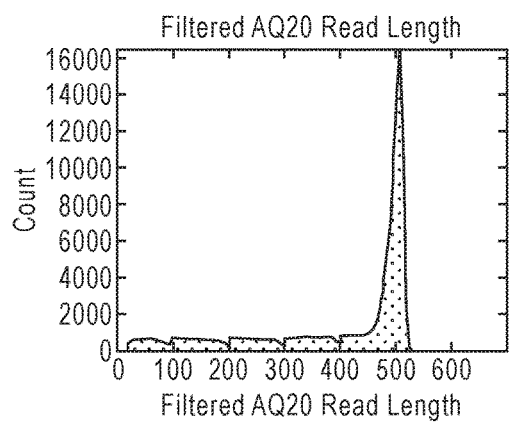
Figure 4G:
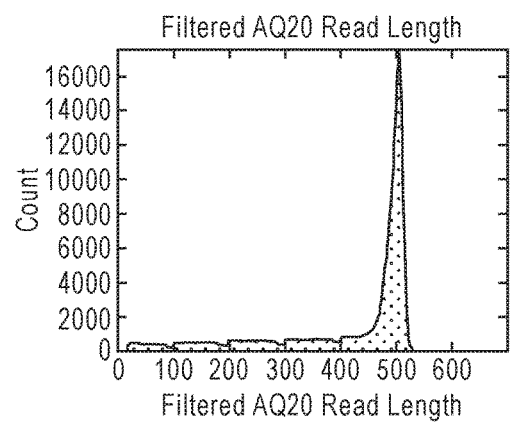
Figure 4F:
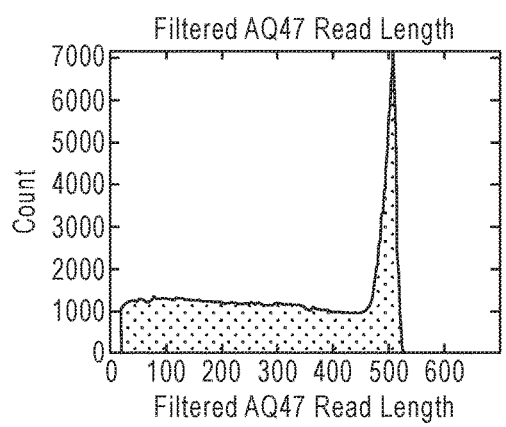
Figure 4H:
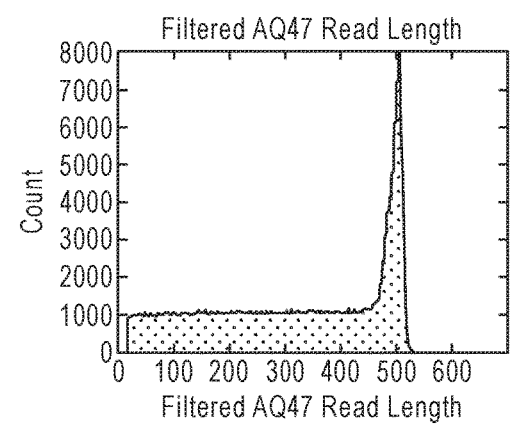
Figure 4I:
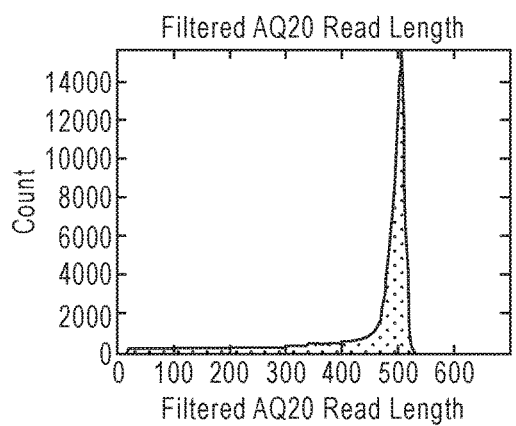
Figure 4K:
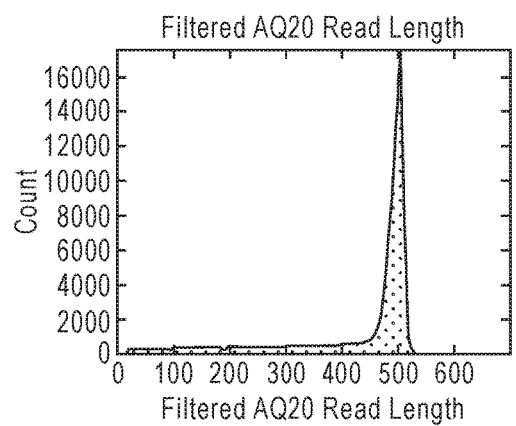
Figure 4J:
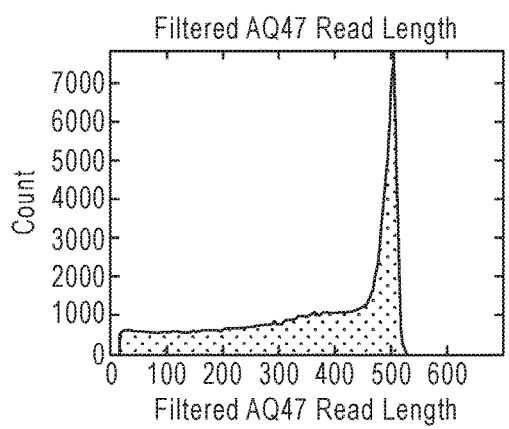
Figure 4L:
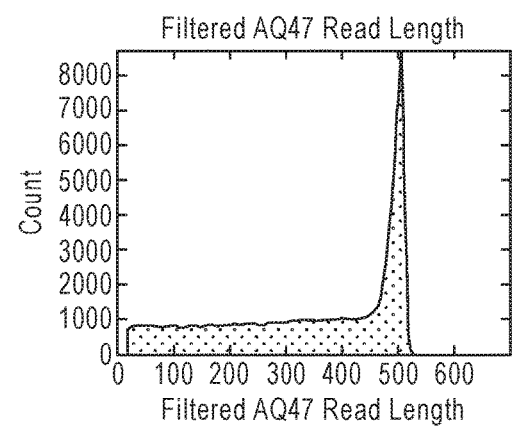

Provided herein are non-naturally occurring mutant, typically recombinant polymerases derived from Bst polymerase, that have improved properties, and methods and kits that include the mutant (e.g. recombinant) polymerases. The mutant (e.g. recombinant) polymerases, in certain exemplary embodiments, when used in a nucleic acid sequencing reaction, yield improved results. For example, the recombinant mutant polymerases herein, in certain illustrative embodiments, when used in a sequencing reaction, such as a sequencing-by-synthesis reaction, including, but not limited to, those that generate and detect hydrogen ions, provide improved accuracy and read length. Thus, the recombinant mutant polymerases provided herein, can be used to improve the accuracy and reduce the cost of nucleic acid sequencing.

As used herein, the term "polymerase" and its variants comprise any enzyme that can catalyze the polymerization of nucleotides (including analogs thereof) into a nucleic acid strand. Typically, but not necessarily such nucleotide polymerization can occur in a template-dependent fashion. Such polymerases can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, homologs, derivatives or fragments thereof that retain the ability to catalyze such polymerization. Optionally, the polymerase can be a mutant polymerase comprising one or more mutations involving the replacement of one or more amino acids with other amino acids, the insertion or deletion of one or more amino acids from the polymerase, or the linkage of parts of two or more polymerases. Typically, the polymerase comprises one or more active sites at which nucleotide binding and/or catalysis of nucleotide polymerization can occur. The term "polymerase" and its variants, as used herein, also refers to fusion proteins comprising at least two portions linked to each other, where the first portion comprises a peptide that can catalyze the polymerization of nucleotides into a nucleic acid strand and is linked to a second portion that comprises a second polypeptide. In some embodiments, the second polypeptide can include a reporter enzyme or a processivity-enhancing domain.

As used herein, the terms "link", "linked", "linkage" and variants thereof comprise any type of fusion, bond, adherence or association that is of sufficient stability to withstand use in the particular biological application of interest. Such linkage can comprise, for example, covalent, ionic, hydrogen, dipole-dipole, hydrophilic, hydrophobic, or affinity bonding, bonds or associations involving van der Waals forces, mechanical bonding, and the like. Optionally, such linkage can occur between a combination of different molecules, including but not limited to: between a nanoparticle and a protein; between a protein and a label; between a linker and a functionalized nanoparticle; between a linker and a protein; between a nucleotide and a label; and the like. Some examples of linkages can be found, for example, in Hermanson, G., Bioconjugate Techniques, Second Edition (2008); Aslam, M., Dent, A., Bioconjugation: Protein Coupling Techniques for the Biomedical Sciences, London: Macmillan (1998); Aslam, M., Dent, A., Bioconjugation: Protein Coupling Techniques for the Biomedical Sciences, London: Macmillan (1998).

The terms "modification" or "modified" and their variants, as used herein with reference to polypeptide or protein, for example a polymerase, comprise any change in the structural, biological and/or chemical properties of the protein. In some embodiments, the modification can include a change in the amino acid sequence of the protein. For example, the modification can optionally include one or more amino acid mutations, including without limitation amino acid additions, deletions and substitutions (including both conservative and non-conservative substitutions). Modification of a polypeptide amino acid sequence that results in the production of a non-naturally occurring polypeptide is referred to herein as a "recombinant" polypeptide. For example, many of the examples herein disclose the use of recombinant DNA polymerases in nucleic acid sequencing or amplification reactions. Additionally, Example 1 outlines how one of ordinary skill in the art can prepare a recombinant DNA polymerase library from a reference polymerase. In some instances, the recombinant DNA polymerase can include one or more amino acid substitutions along the length of the DNA polymerase. In some embodiments, the one or more amino acid substitutions along the length of the DNA polymerase can result in a recombinant DNA polymerase that possesses improved accuracy and/or reduced systematic error rate and/or increased sequencing throughput and/or increased signal to noise ratio as compared to a control polymerase lacking the one or more amino acid substitutions.

The term "conservative" and its variants, as used herein with reference to any change in amino acid sequence, refers to an amino acid mutation wherein one or more amino acids is substituted by another amino acid having highly similar properties. For example, one or more amino acids comprising nonpolar or aliphatic side chains (for example, glycine, alanine, valine, leucine, or isoleucine) can be substituted for each other. Similarly, one or more amino acids comprising polar, uncharged side chains (for example, serine, threonine, cysteine, methionine, asparagine or glutamine) can be substituted for each other. Similarly, one or more amino acids comprising aromatic side chains (for example, phenylalanine, tyrosine or tryptophan) can be substituted for each other. Similarly, one or more amino acids comprising positively charged side chains (for example, lysine, arginine or histidine) can be substituted for each other. Similarly, one or more amino acids comprising negatively charged side chains (for example, aspartic acid or glutamic acid) can be substituted for each other. In some embodiments, the modified polymerase is a variant that comprises one or more of these conservative amino acid substitutions, or any combination thereof. In some embodiments, conservative substitutions for leucine include: alanine, isoleucine, valine, phenylalanine, tryptophan, methionine, and cysteine. In other embodiments, conservative substitutions for asparagine include: arginine, lysine, aspartate, glutamate, and glutamine.

Throughout this disclosure, various amino acid mutations, including, for example, amino acid substitutions are referenced using the amino acid single letter code, and indicating the position of the residue within a reference amino acid sequence. In the case of amino acid substitutions, the identity of the substituent is also indicated using the amino acid single letter code. For example, a reference to the hypothetical amino acid substitution "D166A, wherein the numbering is relative to the amino acid sequence of SEQ ID NO: 7" indicates an amino acid substitution wherein an alanine (A) residue is substituted for the normally occurring aspartic acid (D) residue at amino acid position 166 of the amino acid sequence of SEQ ID NO: 7. Many of the amino acid sequences disclosed herein begin with a methionine residue ("M"), which is typically introduced at the beginning of nucleic acid sequences encoding peptides desired to be expressed in bacterial host cells. However, it is to be understood that the disclosure also encompasses all such amino acid sequences beginning from the second amino acid residue onwards, without the inclusion of the first methionine residue.

As used herein, the terms "identical" or "percent identity," and their variants, when used in the context of two or more nucleic acid or polypeptide sequences, refer to two or more sequences or subsequences that are the same or have a specified percentage of amino acid residues or nucleotides that are the same, when compared and aligned for maximum correspondence, as measured using any one or more of the following sequence comparison algorithms: Needleman-Wunsch (see, e.g., Needleman, Saul B.; and Wunsch, Christian D. (1970). "A general method applicable to the search for similarities in the amino acid sequence of two proteins" Journal of Molecular Biology 48 (3): 443-53); Smith-Waterman (see, e.g., Smith, Temple F.; and Waterman, Michael S., "Identification of Common Molecular Subsequences" (1981) Journal of Molecular Biology 147:195-197); or BLAST (Basic Local Alignment Search Tool; see, e.g., Altschul S F, Gish W, Miller W, Myers E W, Lipman D J, "Basic local alignment search tool" (1990) J Mol Biol 215 (3): 403-410).

As used herein, the terms "substantially identical" or "substantial identity", and their variants, when used in the context of two or more nucleic acid or polypeptide sequences, refer to two or more sequences or subsequences (such as biologically active fragments) that have at least 60%, at least 70%, at least 75%, at least 80%, at least 85%, at least 90%, at least 95%, at least 96%, at least 97%, at least 98%, or at least 99% nucleotide or amino acid residue identity, when compared and aligned for maximum correspondence, as measured using a sequence comparison algorithm or by visual inspection. Substantially identical sequences are typically considered to be homologous without reference to actual ancestry. In some embodiments, "substantial identity" exists over a region of the sequences being compared. In some embodiments, substantial identity exists over a region of at least 25 residues in length, at least 50 residues in length, at least 100 residues in length, at least 150 residues in length, at least 200 residues in length, or greater than 200 residues in length. In some embodiments, the sequences being compared are substantially identical over the full length of the sequences being compared. Typically, substantially identical nucleic acid or protein sequences include less than 100% nucleotide or amino acid residue identity as such sequences would generally be considered "identical".

Proteins and/or protein subsequences (such as biologically active fragments) are "homologous" when they are derived, naturally or artificially, from a common ancestral protein or protein sequence. Similarly, nucleic acids and/or nucleic acid sequences are homologous when they are derived, naturally or artificially, from a common ancestral nucleic acid or nucleic acid sequence. Homology is generally inferred from sequence similarity between two or more nucleic acids or proteins (or biologically active fragments or sequences thereof). The precise percentage of similarity between sequences that is useful in establishing homology varies with the nucleic acid and protein at issue, but as little as 25% sequence similarity over 25, 50, 100, 150, or more nucleic acids or amino acid residues, is routinely used to establish homology. Higher levels of sequence similarity, e.g., 30%, 40%, 50%, 60%, 70%, 80%, 85%, 90%, 95%, 98% or 99%, can also be used to establish homology.

Methods for determining homology or sequence similarity percentages (e.g., BLASTP and BLASTN using default parameters) are described herein and are generally available. For sequence comparison and homology determination, typically one sequence acts as a reference sequence to which test sequences are compared. Table 1 provided herein provides an exemplary list of homologous amino acid mutations across four different classes of DNA polymerase, namely a full-length Bst DNA polymerase (SEQ ID NO: 16), the large fragment of Bst DNA polymerase (SEQ ID NO: 1), Taq DNA polymerase (SEQ ID NO: 15) and Klenow fragment polymerase (SEQ ID NO: 18). Table 1 provides an exemplary list of several amino acid positions that may be mutated in SEQ ID NO: 1 and identifies the corresponding amino acid position in each of the other polymerases presented (i.e., a homolog). For example, amino acid substitution E220K in SEQ ID NO: 1 was found to be homologous to E515K in SEQ ID 16, E245K in SEQ ID NO: 18 and E471K in SEQ ID NO: 15. It will be readily apparent to the skilled artisan that a variety of publically available alignment tools can be used to identify homologous amino acid mutations (such as amino acid substitutions) across a polymerase amino acid sequence, for example the NCBI alignment and BLAST tools. Generally, when using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters. Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Current Protocols in Molecular Biology, Ausubel et al., eds., Current Protocols, a joint venture between Greene Publishing Associates, Inc. and John Wiley & Sons, Inc., supplemented through 2004). One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information. This algorithm involves first identifying high scoring sequence pairs (HSPs) by identifying short words of length "W" in the query sequence, which either match or satisfy some positive-valued threshold score "T" when aligned with a word of the same length in a database sequence. "T" is referred to as the neighborhood word score threshold (Altschul et al., supra). These initial neighborhood word hits act as seeds for initiating searches to find longer HSPs containing them. The word hits are then extended in both directions along each sequence for as far as the cumulative alignment score can be increased. Cumulative scores are calculated using, for nucleotide sequences, the parameters "M" (reward score for a pair of matching residues; always >0) and "N" (penalty score for mismatching residues; always <0). For amino acid sequences, a scoring matrix is used to calculate the cumulative score. Extension of the word hits in each direction are halted when: the cumulative alignment score falls off by the quantity X from its maximum achieved value; the cumulative score goes to zero or below, due to the accumulation of one or more negative-scoring residue alignments; or the end of either sequence is reached. The BLAST algorithm parameters "W", "T", and "X" determine the sensitivity and speed of the alignment. The BLASTN program (for nucleotide sequences) uses as defaults a wordlength (W) of 11, an expectation (E) of 10, a cutoff of 100, M=5, N=−4, and a comparison of both strands. For amino acid sequences, the BLASTP program uses as defaults a wordlength (W) of 3, an expectation (E) of 10, and the BLOSUM62 scoring matrix (see Henikoff & Henikoff (1989) Proc. Natl. Acad. Sci. USA 89:10915).

In addition to calculating percent sequence identity, the BLAST algorithm also performs a statistical analysis of the similarity between two sequences (see, e.g., Karlin & Altschul, Proc. Nat'l. Acad. Sci. USA 90:5873-5787 (1993)). One measure of similarity provided by the BLAST algorithm is the smallest sum probability (P(N)), which provides an indication of the probability by which a match between two nucleotide or amino acid sequences would occur by chance. For example, a nucleic acid is considered similar to a reference sequence if the smallest sum probability in a comparison of the test nucleic acid to the reference nucleic acid is less than about 0.1, less than about 0.01, or less than about 0.001.

The term "primer extension activity" and its variants, as used herein, when used in reference to a given polymerase, comprise any in vivo or in vitro enzymatic activity characteristic of a given polymerase that relates to catalyzing nucleotide incorporation onto the terminal 3'OH end of an extending nucleic acid molecule. Typically, but not necessarily such nucleotide incorporation occurs in a template-dependent fashion. In some embodiments, the primer extension activity of a given polymerase can be quantified as the total number of nucleotides incorporated (as measured by, e.g., radiometric or other suitable assay) by a unit amount of polymerase (in moles) per unit time (seconds) under a particular set of reaction conditions.

The term "DNA binding activity" and its variants, as used herein, when used in reference to a given polymerase, comprise any in vivo or in vitro enzymatic activity characteristic of a given polymerase that relates to interaction of the polymerase with a DNA sequence in a recognition-based manner. Typically, but not necessarily such interaction includes binding of the polymerase, and more specifically binding of the DNA-binding domain of the polymerase, to the recognized DNA sequence. In some embodiments, recognition includes binding of the polymerase to a sequence-specific or non-sequence specific DNA sequence. In some embodiments, the DNA binding activity of a given polymerase can be quantified as the affinity of the polymerase to recognize and bind to the recognized DNA sequence. For example, DNA binding activity can be monitored and determined using an anistrophy signal change (or other suitable assay) as a protein-DNA complex is formed under a particular set of reaction conditions.

As used herein, the term "biologically active fragment" and its variants, when used in reference to a given biomolecule, refers to any fragment, derivative, homolog or analog of the biomolecule that possesses an in vivo or in vitro activity that is characteristic of the biomolecule itself. For example, a polymerase can be characterized by various biological activities, for example DNA binding activity, nucleotide polymerization activity, primer extension activity, strand displacement activity, reverse transcriptase activity, nick-initiated polymerase activity, 3'-5' exonuclease (proofreading) activity, and the like. In some embodiments, a "biologically active fragment" of a polymerase is any fragment, derivative, homolog or analog of the polymerase that can catalyze the polymerization of nucleotides (including homologs and analogs thereof) into a nucleic acid strand. In some embodiments, the biologically active fragment, derivative, homolog or analog of the polymerase possesses 10%, 20%, 30%, 40%, 50%, 60%, 70%, 75%, 80%, 85%, or 90% or greater of the biological activity of the polymerase in any in vivo or in vitro assay of interest such as, for example, DNA binding assays, nucleotide polymerization assays (which may be template-dependent or template-independent), primer extension assays, strand displacement assays, reverse transcriptase assays, proofreading assays, and the like. In some embodiments, the biological activity of a polymerase fragment can be assayed by measuring the primer extension activity in vitro of the fragment under defined reaction conditions. In some embodiments, the biological activity of a polymerase fragment can be assayed by measuring the polymerization activity in vitro of the fragment under defined reaction conditions. In some embodiments, the biological activity of a polymerase fragment can be assayed by measuring the DNA binding activity in vitro of the fragment under defined reaction conditions. In some embodiments, the biological activity of a polymerase fragment can be assayed by measuring the strand displacement activity in vitro of the fragment under defined reaction conditions. In some embodiments, the biological activity of a polymerase fragment can be assayed by measuring the reverse transcriptase activity in vitro of the fragment under defined reaction conditions. In some embodiments, the biological activity of a polymerase fragment can be assayed by measuring the nick-initiated polymerase activity in vitro of the fragment under defined reaction conditions. In some embodiments, the biological activity of a polymerase fragment can be assayed by measuring the proofreading activity in vitro of the fragment under defined reaction conditions. In some embodiments, the biologically active fragment of a polymerase can include measuring the biological activity of any one or more of the polymerase biological activities outlined herein.

Biologically active fragments can optionally exist in vivo, such as, for example, fragments which arise from post transcriptional processing or which arise from translation of alternatively spliced RNAs, or alternatively can be created through engineering, bulk synthesis, or other suitable manipulation. Biologically active fragments include fragments expressed in native or endogenous cells as well as those made in expression systems such as, for example, in bacterial, yeast, insect or mammalian cells.

In some embodiments, provided herein is not only the specific polymerases disclosed herein, but also to any biologically active fragment of such polymerases, which are encompassed within the scope of the present disclosure. In some embodiments, a biologically active fragment of any polymerase of the disclosure includes any fragment that exhibits primer extension activity and DNA binding activity in vitro. In some embodiments, a biologically active fragment of any polymerase of the disclosure includes any fragment that retains polymerase activity in vitro. Polymerase activity can be determined by any method known in art. For example, determination of polymerase activity can be based on the activity of extending a primer on a template.

In some embodiments, the disclosure generally relates to a modified polymerase having one or more amino acid mutations (such as a deletion, substitution or addition) relative to a reference polymerase lacking the one or more amino acid mutations, and wherein the modified polymerase retains polymerase activity in vitro, exhibits DNA binding activity in vitro or exhibits primer extension activity in vitro. In some embodiments, the modified polymerase includes any biologically active fragment of such polymerase that retains polymerase activity in vitro, exhibits DNA binding activity in vitro or exhibits primer extension activity in vitro.

In some embodiments, the disclosure generally relates to a modified polymerase having one or more amino acid mutations (such as a deletion, substitution or addition) relative to a reference polymerase lacking the one or more amino acid mutations, and wherein the modified polymerase retains proofreading activity in vitro. In some embodiments, the disclosure generally relates to a modified polymerase having one or more amino acid mutations (such as a deletion, substitution or addition) relative to a reference polymerase lacking the one or more amino acid mutations, and wherein the modified polymerase retains proofreading activity in vitro, exhibits nick-initiated polymerase activity in vitro or reverse transcriptase activity in vitro. In some embodiments, the modified polymerase includes any biologically active fragment of such polymerase that retains proofreading activity in vitro, exhibits nick-initiated polymerase activity in vitro or exhibits reverse transcriptase activity in vitro. Determination of whether a polymerase exhibits exonuclease activity or exhibits reduced exonuclease activity, can be readily determined by standard methods. For example, polynucleotides can be synthesized such that a detectable proportion of the nucleotides are radioactively labeled. These polynucleotides can be incubated in an appropriate buffer in the presence of the polypeptide to be tested. After incubation, the polynucleotide is precipitated and exonuclease activity is detectable as radioactive counts due to free nucleotides in the supernatant. As will be appreciated by the skilled artisan, an appropriate polymerase or biologically active fragment may be selected from those described herein based on any of the above biological activities, or combinations thereof, depending on the application of interest.

As used herein, the term "nucleotide" and its variants comprise any compound that can bind selectively to, or can be polymerized by, a polymerase. Typically, but not necessarily, selective binding of the nucleotide to the polymerase is followed by polymerization of the nucleotide into a nucleic acid strand by the polymerase; occasionally however the nucleotide may dissociate from the polymerase without becoming incorporated into the nucleic acid strand, an event referred to herein as a "non-productive" event. Such nucleotides include not only naturally occurring nucleotides but also any analogs, regardless of their structure, that can bind selectively to, or can be polymerized by, a polymerase. While naturally-occurring nucleotides typically comprise base, sugar and phosphate moieties, the nucleotides of the disclosure can include compounds lacking any one, some or all of such moieties. In some embodiments, the nucleotide can optionally include a chain of phosphorus atoms comprising three, four, five, six, seven, eight, nine, ten or more phosphorus atoms. In some embodiments, the phosphorus chain can be attached to any carbon of a sugar ring, such as the 5' carbon. The phosphorus chain can be linked to the sugar with an intervening O or S. In one embodiment, one or more phosphorus atoms in the chain can be part of a phosphate group having P and O. In another embodiment, the phosphorus atoms in the chain can be linked together with intervening O, NH, S, methylene, substituted methylene, ethylene, substituted ethylene, $CNH_2$, $C(O)$, $C(CH_2)$, $CH_2CH_2$, or $C(OH)CH_2R$ (where R can be a 4-pyridine or 1-imidazole). In one embodiment, the phosphorus atoms in the chain can have side groups having O, BH3, or S. In the phosphorus chain, a phosphorus atom with a side group other than O can be a substituted phosphate group. Some examples of nucleotide analogs are described in Xu, U.S. Pat. No. 7,405,281. In some embodiments, the nucleotide comprises a label (e.g., reporter moiety) and referred to herein as a "labeled nucleotide"; the label of the labeled nucleotide is referred to herein as a "nucleotide label". In some embodiments, the label can be in the form of a fluorescent dye attached to the terminal phosphate group, i.e., the phosphate group or substitute phosphate group most distal from the sugar. Some examples of nucleotides that can be used in the disclosed methods and compositions include, but are not limited to, ribonucleotides, deoxyribonucleotides, modified ribonucleotides, modified deoxyribonucleotides, ribonucleotide polyphosphates, deoxyribonucleotide polyphosphates, modified ribonucleotide polyphosphates, modified deoxyribonucleotide polyphosphates, peptide nucleotides, metallonucleosides, phosphonate nucleosides, and modified phosphate-sugar backbone nucleotides, analogs, derivatives, or variants of the foregoing compounds, and the like. In some embodiments, the nucleotide can comprise non-oxygen moieties such as, for example, thio- or borano-moieties, in place of the oxygen moiety bridging the alpha phosphate and the sugar of the nucleotide, or the alpha and beta phosphates of the nucleotide, or the beta and gamma phosphates of the nucleotide, or between any other two phosphates of the nucleotide, or any combination thereof.

As used herein, the term "nucleotide incorporation" and its variants comprise polymerization of one or more nucleotides to form a nucleic acid strand including at least two nucleotides linked to each other, typically but not necessarily via phosphodiester bonds, although alternative linkages may be possible in the context of particular nucleotide analogs.

As used herein, the term "processivity" and its variants comprise the ability of a polymerase to remain bound to a single primer/template hybrid. In some embodiments, processivity can be measured by the number of nucleotides that a polymerase incorporates into a nucleic acid (such as a sequencing primer) prior to dissociation of the polymerase from the primer/template hybrid. In some embodiments, the polymerase has a processivity of at least 100 nucleotides, although in other embodiments it can include a processivity of at least 200 nucleotides, at least 300 nucleotides, at least 400 nucleotides, at least 500 nucleotides or greater. It will be understood by those of ordinary skill in the art that the higher the processivity of the polymerase, the more nucleotides that can be incorporated prior to dissociation and therefore the longer the sequence (read-length) that can be obtained. In other words, polymerases having low processivity will typically provide shorter average read-lengths than will polymerases having higher processivity. In one embodiment, polymerases of the instant disclosure containing one or more amino acid mutations can possess enhanced processivity as compared to a control polymerase lacking the one or more amino acid mutations.

In one exemplary assay, the processivity of a given polymerase can be measured by incubating the polymerase with a primer:template duplex under nucleotide incorporation conditions, and resolving the resulting primer extension products using any suitable method, for example via gel electrophoresis. The primer can optionally include a label to enhance detectability of the primer extension products. The nucleotide incorporation reaction mixture typically includes a vast excess of unlabeled competitor template, thereby ensuring that virtually all of the extension products are produced through a single template binding event. Following such resolution, the average amount of full-length extension products can be quantified using any suitable means, including fluorimetric or radiometric detection of full-length extension products. To compare the processivity of two or more different enzymes (e.g., reference and modified polymerases), each enzyme can be employed in a parallel and separate reaction, following which the resulting full-length primer extension products can be resolved and measured, and such measurements compared.

In other exemplary embodiments, the processivity of a given polymerase can be measured using any suitable assay known in the art, including but not limited to the assays described in Von Hippel, P. H., Faireld, F. R. and Dolejsi, M. K., On the processivity of polymerases, Ann. NY Acad. Sci., 726:118-131 (1994); Bambara, R. A., Uyemura, D. and Choi, T., On the processive mechanism of Escherichia coli DNA polymerase I. Quantitative assessment of processivity, J. Biol. Chem., 253:413-423 (1978); Das, S. K. and Fujimura, R. K., Processiveness of DNA polymerases. A comparative study using a simple procedure, J. Biol. Chem., 254: 1227-1232 (1979); Nasir, M. S. and Jolley, M. E., Fluorescence polarization: An Analytical Tool for Immunoassay and Drug Discovery, Combinational Chemistry and High Throughput Screening, 2:177-190 (1999); Mestas, S. P., Sholders, A. J., and Peersen, O. B., A Fluorescence Polarization Based Screening Assay for Nucleic Acid Polymerase Elongation Activity, Anal. Biochem., 365:194-200 (2007); Nikiforov, T. T., Fluorogenic polymerase, endonuclease, and ligase assays based on DNA substrates labeled with a single fluorophore, Analytical Biochemistry 412: 229-236; and Yan Wang, Dennis E. Prosen, Li Mei, John C. Sullivan, Michael Finney and Peter B. Vander Horn, Nucleic Acids Research, 32(3): 1197-1207 (2004).

The terms "read length" or "read-length" and their variants, as used herein, refer to the number of nucleotides that are polymerized (or incorporated into an existing nucleic acid strand) in a template-dependent manner by a polymerase prior to dissociation from a template nucleic acid strand. In some embodiments, a polymerase that dissociates from the template nucleic acid strand after five incorporations will typically provide a sequence having a read length of 5 nucleotides, while a polymerase that dissociates from the template nucleic acid strand after 500 nucleotide incorporations will typically provide a sequence having a read length of about 500 nucleotides. While the actual or absolute processivity of a given polymerase (or the actual read length of polymerization products produced by the polymerase) can vary from reaction to reaction (or even within a single reaction mixture wherein the polymerase produces different products having different read lengths), the polymerase can be characterized by the average processivity (or average read length of polymerization products) observed under a defined set of reaction conditions. The "error-free read length" comprises the number of nucleotides that are consecutively and contiguously incorporated without error (i.e., without mismatch and/or deviation from an established and predictable set of base pairing rules) into the newly synthesized nucleic acid strand.

The terms "systematic error" or "SE" or "SSE" and its variants, as used herein, refers to the percentage of errors in sequence motifs containing homopolymers (HPs) of a defined length, with systematic deletion occurring on strand at a specified minimum frequency, and with sequencing coverage of a specified minimum frequency. For example, in some embodiments the systematic error can be measured as the percentage of errors in sequence motifs containing homopolymers of length 1-6, with systematic deletion occurring on strand with a frequency greater than 15%, when coverage (of the sequencing run) is equal to or greater than 20×. In some embodiments, the systematic error is estimated as the percentage of stochastic errors in sequence motifs containing homopolymers of length 1-6, with systematic deletion occurring on strand with a frequency greater than 15%, when coverage (of the sequencing run) is equal to or greater than 20×. Thus, an SSE of 0.3435% means that 0.3435% of all positions have systematic strand error. In some embodiments, the percentage of systematic error is lowered when using a mutant (e.g. recombinant) polymerase as disclosed herein as compared to a reference polymerase (e.g., a wild-type polymerase, polymerase of SEQ ID NO: 2, or polymerase of SEQ ID NO: 35 (PSP4)) that does not contain the one or more amino acid mutations, or contains some, but not all of the amino acid mutations. For example, While the actual systematic error of a given polymerase can vary from reaction to reaction (or even within a single reaction mixture) the polymerase can be characterized by the percentage systematic error observed under a defined set of reaction conditions. In some embodiments, the mutant polymerases of the instant application have a lowered systematic error percentage as compared to a corresponding reference polymerase not having one or more of the amino acid modifications, for example, as compared to SEQ ID NO: 16, SEQ ID NO: 2, or SEQ ID NO; 35, SEQ ID NO: 1, SEQ ID NO: 120, or SEQ ID NO: 122. In illustrative examples, the comparison is to SEQ ID NO: 35. In some embodiments, the mutant (e.g. recombinant) polymerases of the present invention yield a systematic error percentage of less than 1%, 0.9%, 0.8%, 0.75%, 0.7%, 0.6%, 0.5%, 0.4%, or 0.3% average systematic error (average SSE), as provided in the Examples herein, when used in a sequencing by synthesis reaction wherein hydrogen ions are generated and detected, such as the Ion Torrent system. The mutant (e.g. recombinant) polymerases provided herein can have a statistically significant reduction in systematic error and/or a systematic error rate that is between 5, 10, 15, 20, 25, 30, 35, 40, 45, or 50% on the low end of the range and 10, 15, 20, 25, 30, 35, 40, 45, 50, 60, 70, 75, 80, 85, or 90% on the high end of the range, lower than the average SSE obtained using a reference polypeptide such as SEQ ID NO: 1, SEQ ID NO: 2, SEQ ID NO: 35, SEQ ID NO: 16, SEQ ID NO: 120, or SEQ ID NO: 122. In illustrative embodiments, an isolated, mutant (e.g. recombinant) polymerase provided herein can has a statistically significant reduction in systematic error and/or a systematic error rate that is between 5, 10, 15, 20, and 25% on the low end of the range and 10, 15, 20, 25, 30, 35, 40, 45, and 50% on the high end of the range, lower than the average SSE obtained using SEQ ID NO: 35 as a reference polymerase. In illustrative examples for the above ranges, SSE is measured as percentage of stochastic errors in sequence motifs containing homopolymers of length 1-6, with systematic deletion occurring on strand with a frequency greater than 15%, when coverage (of the sequencing run) is equal to or greater than 20×).

The term "strand bias" as used herein, refers to the percentage of target bases in a sequencing run where the read (genotype) from one strand (e.g., positive) is different from the read (genotype) inferred from the other (e.g., negative) strand. The coverage of a given target base is computed by counting the number of read bases mapped to it in an alignment. The mean coverage is computed by averaging this value across every base in the target. Then the relative coverage for a particular base is computed as the ratio of these values. A relative coverage of 1 indicates that a particular base is covered at the expected average rate. A relative coverage above 1 indicates higher than expected coverage and below 1 indicates lower than expected coverage. Generally, the probability of ambiguous mapping increases as reads become shorter or less accurate. Ambiguous mapping is also more likely for reads that derive from repetitive or low complexity regions of the genome, including some regions with extreme GC content. In some embodiments, the percentage of strand bias is lowered when using a modified polymerase as disclosed herein, as compared to a reference polymerase (e.g., a wild-type polymerase) that does not contain the corresponding one or more amino acid modifications. In some embodiments, the modified polymerases of the instant application have a decreased strand bias as compared to the corresponding non-modified polymerase. While the actual strand bias of a given polymerase can vary from reaction to reaction (or even within a single reaction mixture) the polymerase can be characterized by the percentage of target bases with no strand bias, observed under a defined set of reaction conditions. In some embodiments, the modified polymerases as disclosed herein comprise a percentage of target bases with no strand bias of above 25%. In some embodiments, the modified polymerases as disclosed herein comprise a percentage of target bases with no strand bias of about 30%. In some embodiments, the modified polymerases as disclosed herein comprise a percentage of target bases with no strand bias of about 40%. In some embodiments, the modified polymerases as disclosed herein comprise a percentage of target bases with no strand bias of about 45%. In some embodiments, the modified polymerases as disclosed herein comprise a percentage of target bases with no strand bias of about 50%. In some embodiments, the modified polymerases as disclosed herein comprise a percentage of target bases with no strand bias of about 60%. In some embodiments, the modified polymerases as disclosed herein comprise a percentage of target bases with no strand bias of about 70%. In some embodiments, the modified polymerases as disclosed herein comprise a percentage of target bases with no strand bias of about 75%. In some embodiments, the modified polymerases as disclosed herein comprise a percentage of target bases with no strand bias of about 80%. In some embodiments, the modified polymerases as disclosed herein comprise a percentage of target bases with no strand bias of about 85%. Conversely, in some embodiments the modified polymerases as disclosed herein can include about 15% percent of target bases with strand bias. In another embodiment, the modified polymerases as disclosed herein can include about 20%, 25%, 30%, 35%, 40%, 45% or 50% percent of target bases with strand bias.

The terms "signal to noise ratio" or "SNR" refer to the ratio of signal power to noise power. Generally, SNR is a method of measuring a desired signal compared to the level of background noise. In some embodiments, "signal to noise ratio" can refer to the ratio of signal power obtained during a sequencing run as compared to background noise of the same sequencing run. In some embodiments, the instant application discloses methods, kits, apparatuses, and compositions that provide a means to increase the signal to noise ratio. In some embodiments, provided herein is a method for performing nucleic acid sequencing comprising contacting a modified polymerase with a nucleic acid template in the presence of one or more nucleotides, where the modified polymerase includes one or more amino acid modifications relative to a reference polymerase and has an increased signal to noise ratio relative to the reference polymerase not having the one or more amino acid mutations, and polymerizing at least one of the one or more nucleotides using the modified polymerase.

Key Signal is the amount of signal generated by a sequencing system when sequencing a known control sequence that is added to the 5' end of a sequence of interest during sample preparation for a sequencing reaction. The Key Signal is dependent upon the rate of proton generation (which is directly related to nucleotide incorporation rate) and the amount of buffering in the system. Increased incorporation rate should increase Key Signal, while increased buffering should decrease signal. We hypothesized that since Histidines have a pKa of 6.5, they might be a significant source of buffering when present on an enzyme used in a sequencing reaction. Therefore, we hypothesized that removal of Histidines might provide an increased signal in an ion-detecting sequencing system such as the Ion Torrent system. As demonstrated in the Examples herein, some of the mutant polymerases of the invention provide increased signal, such as H473G and H528T substitutions, numbering with reference to SEQ ID NO: 1.

In some embodiments, provided herein is compositions, methods, systems, apparatuses and kits comprising modified polymerases that are characterized by increased processivity, read length (including error-free read length), total sequencing throughput and/or accuracy as compared to their unmodified counterparts (e.g., reference polymerase), as well as to methods for making and using such modified polymerases in a wide range of biological and chemical reactions such as nucleotide polymerization, primer extension, generation of nucleic acid libraries and nucleic acid sequencing reactions. In some embodiments, provided herein is compositions, methods, systems, apparatuses and kits comprising modified polymerases that are characterized decreased strand bias and/or systematic error as compared to their unmodified counterparts (e.g., reference polymerase), as well as to methods for making and using such modified polymerases in a wide range of biological and chemical reactions such as nucleotide polymerization, primer extension, generation of nucleic acid libraries and nucleic acid sequencing reactions. In some embodiments, the modified polymerases include one or more amino acid mutations (e.g., amino acid substitutions, additions or deletions) relative to their corresponding unmodified counterparts. In some embodiments, the term accuracy as used herein can be measured by determining the rate of incorporation of a correct nucleotide during polymerization as compared to the rate of incorporation of an incorrect nucleotide during polymerization. In some embodiments, the rate of incorporation of an incorrect nucleotide can be greater than 0.3, 0.4, 0.5, 0.6, 0.7 seconds or more under elevated salt conditions (high ionic strength solution) as compared to standard (lower) salt conditions. While not wishing to be bound by any particular theory, it has been found by the applicants that the presence of elevated salt during polymerization slows down the rate of incorporation of the incorrect nucleotide, thereby producing a slower incorporation constant for the incorrect nucleotide. In some embodiments, a modified polymerase of the disclosure has enhanced accuracy compared to a relative polymerase, optionally the modified polymerase or a biological fragment thereof has enhanced accuracy (as compared to a relative polymerase) in the presence of a high ionic strength solution.

In some embodiments, provided herein is a modified polymerase that retains polymerase activity in the presence of a high ionic strength solution. In some embodiments, the high ionic strength solution can be 120 mM to 300 mM salt. In some embodiments, the high ionic strength solution can be 130 mM salt. In some embodiments, the high ionic strength solution can be at least 125 mM salt, such as KCl and/or NaCl. In some embodiments, the high ionic strength solution can be about 225 mM to about 250 mM salt. In some embodiments, the salt can include a potassium and/or sodium salt, such as KCl and/or NaCl. It will be apparent to the skilled artisan that various other suitable salts can be used in place, or in combination with KCl and/or NaCl. In some embodiments, the ionic strength solution can further include a sulfate.

In some embodiments, the modified polymerase can amplify and/or sequence a nucleic acid molecule in the presence of a high ionic strength solution. In some embodiments, a modified polymerase is capable of amplifying (and/or sequencing) a nucleic acid molecule in the presence of a high ionic strength solution to a greater extent (for example as measured by accuracy) than a reference polymerase lacking one or more of the same mutations (or homologous mutations) under identical conditions. In some embodiments, a modified polymerase is capable of amplifying (and/or sequencing) a nucleic acid molecule in the presence of a high ionic strength solution to a greater capacity (for example as measured by accuracy) than a reference polymerase lacking one or more of the mutations (or homologous mutations) under standard ionic strength conditions (i.e., lower ionic strength as compared to a high ionic strength solution).

In some embodiments, the disclosure generally relates to a modified polymerase or a biologically active fragment thereof that can perform nucleotide polymerization or nucleotide incorporation in the presence of elevated salt conditions (in excess of 120 mM salt) as compared to a reference polymerase.

In some embodiments, the disclosure generally relates to a modified polymerase or a biologically active fragment thereof that has increased accuracy or increased dissociation time constant in the presence of elevated salt conditions (in excess of 120 mM salt) as compared to a reference polymerase.

In some embodiments, the disclosure generally relates to a modified polymerase or a biologically fragment thereof that can detect a change in ion concentration during nucleotide polymerization in the presence of elevated salt conditions (in excess of 120 mM salt) as compared to a reference polymerase.

In some embodiments, the disclosure generally relates to a modified polymerase or a biologically active fragment thereof that can amplify or can be used in a nucleic acid sequencing reaction in the presence of elevated salt conditions (in excess of 120 mM salt).

In some embodiments, the disclosure generally relates to a modified polymerase or a biologically active fragment thereof that yields increased accuracy in a nucleic acid sequencing reaction as compared to a reference polymerase.

In some embodiments, the disclosure generally relates to a mutant, typically recombinant DNA polymerase or a biologically active fragment thereof, that yields improved accuracy and/or increased dissociation time constant and/or lower systematic error rates as compared to a control polymerase under identical conditions. Those conditions can include 120 mM salt, or even in excess of 120 mM salt, such as 120 mM to 200 mM salt, such as NaCl and/or KCl.

The control or reference polymerase discussed throughout the specification and illustrated in the Examples section, can have one or more of the mutations, but does not have all of the mutations of the polymerases of the invention. For example, in certain illustrative embodiments, the control polymerase is a recombinant Bst DNA polymerase fragment that has the sequence of wild type Bst polymerase as well as mutations H46R, E446Q and H572R (position numbering relative to the Bst DNA polymerase fragment of SEQ ID NO: 1). These mutations are sometimes referred to herein as the core buffering mutations. For example, SEQ ID NO: 2 is a 581 amino acid Bst polymerase fragment that can be used as a reference polymerase and that includes these mutations. A full length version (876 amino acids) of Bst polymerase having these same 3 core buffering mutations, that can be used as a reference polymerase, is SEQ ID NO: 122. In other embodiments, a reference polymerase can be a Bst polymerase having a wild type Bst polymerase sequence except for the 3 core buffering mutations plus an additional 3 mutations: H281M, D423K, and N487R (position numbering relative to SEQ ID NO: 1). A Bst polymerase fragment of 581 amino acids that has these 6 mutations in a wild-type background sequence is SEQ ID NO: 35. A full length version (876 amino acids) of this control Bst polypeptide with these 6 mutations is SEQ ID NO: 120.

In some embodiments, the disclosure generally relates to a recombinant DNA polymerase or a biologically fragment thereof that can detect a change in ion concentration during nucleotide polymerization in the presence of at least 120 mM salt.

In some embodiments, the disclosure generally relates to a recombinant DNA polymerase or a biologically active fragment thereof that can amplify a polynucleotide or can be used in a method to obtain nucleic acid sequence information in the presence of at least or in excess of 120 mM salt. For example, a modified, mutant, and/or recombinant polymerase of the present invention, can be used in a high throughput sequencing reaction, especially a sequencing reaction that involves the generation and release of hydrogen ions and detection of those ions.

Table 2 lists certain 581 amino acid fragment and full length Bst Polymerases that are referred to in this specification.

TABLE 2

| | Amino Acid Mutation(s) | Length (No. Amino Acids) |
|---|---|---|
| SEQ ID NO: 1 | None | 581 |
| SEQ ID NO: 2 | H46R, E446Q, H572R | 581 |
| SEQ ID NO: 35 | H46R, E446Q, H572R, H281M, D423K, N487R | 581 |
| SEQ ID NO: 119 | H46R, E446Q, H572R, H281M, D423K, N487R, L252R, H528T, H473G | 581 |
| SEQ ID NOS: 79-118 | H46R, E446Q, H572R, H281M, D423K, N487R and one of V241K, G209Q, N234K, N234R, P236I, P236R, E220H, E220K, E220T, S260K, T324R, E267M, E267K, E267R, E277T, E294K, E456R, E493G, E493R, E442R, E442Y, M495C, E325R, A492K, D480L, D480R, A344Y, E245R, E30K, N517C, N517K, V251R, N485R, E522C, D264K, D264M, H528T, H473G, L252R, or L252R + H528T (the order of amino acid mutations corresponds to the order of SEQ ID NOS.) | 581 |
| SEQ ID NO: 16 | None | 876 |
| SEQ ID NO: 31 | H576M, D718K, N782R | 876 |
| SEQ ID NO: 78 | H576M, D718K, N782R, L547R, H768G, H823T | 876 |
| SEQ ID NO: 120 | H341R, E741Q, H867R, H576M, D718K, N782R | 876 |
| SEQ ID NO: 121 | H341R, E741Q, H867R, H576M, D718K, N782R, L547R, H768G, H823T | 876 |
| SEQ ID NO: 122 | H341R, E741Q, H867R | 876 |
| SEQ ID NOS: 38-77 | H576M, D718K, N782R and one of V536K, G504Q, N529K, N529R, P531I, P531R, E515H, E515K, E515T, S555K, T619R, E562M, E562K, E562R, E572T, E589K, E751R, E788G, E788R, E737R, E737Y, M790C, E620R, A787K, D775L, D775R, A639Y, E540R, E325K, N812C, N812K, V546R, N780R, E817C, D559K, D599M, H823T, H768G, L547R, or L252R + H528T (the order of amino acid mutations corresponds to the order of SEQ ID NOS.) | 876 |

All 581 amino acid Bst DNA polymerase fragment mutants provided herein have the same base C-terminal 581 amino acids of SEQ ID NO: 1 except for the mutations as indicated in this specification (e.g. in Table 2) and in the sequence listing filed herewith.

SEQ ID NO: 35 includes six amino acid substitutions relative to SEQ ID NO: 1, namely H46R, E446Q, H572R, H281M, D423K and N487R, where the numbering is relative to the amino acid sequence of SEQ ID NO: 1.

SEQ ID NO: 119 includes nine amino acid substitutions relative to SEQ ID NO: 1, namely H46R, E446Q, H572R, H281M, D423K, N487R, L252R, H528T, and H473G, where the numbering is relative to the amino acid sequence of SEQ ID NO: 1.

SEQ ID Nos: 79-118 each include mutations H46R, E446Q, H572R, H281M, D423K, N487R and one additional mutation, as indicated in Table 2.

SEQ ID NOs: 38-77 each include mutations H576M, D718K, and N782R, and one additional mutation, as indicated in Table 2.

SEQ ID NO: 31 includes three amino acid substitutions relative to SEQ ID NO: 16, namely H576M, D718K, and N782R, where the numbering is relative to the amino acid sequence of SEQ ID NO: 16.

SEQ ID NO: 120 includes six amino acid substitutions relative to SEQ ID NO: 16, namely H341R, E741Q, H867R, H576M, D718K, and N782R, where the numbering is relative to the amino acid sequence of SEQ ID NO: 16.

SEQ ID NO: 121 includes nine amino acid substitutions relative to SEQ ID NO: 16, namely H341R, E741Q, H867R, H576M, D718K, N782R, L547R, H768G and H823T where the numbering is relative to the amino acid sequence of SEQ ID NO: 16.

SEQ ID NO: 122 includes three amino acid substitutions relative to SEQ ID NO: 16, namely H341R, E741Q, and H867R, where the numbering is relative to the amino acid sequence of SEQ ID NO: 16.

The large fragment of the Bst DNA polymerase is 581 amino acid residues in length and is the C terminal 581 amino acid residues of the full length Bst DNA polymerase. Full length Bst DNA polymerase is an 876 amino acids enzyme. Accordingly, to identify corresponding residue numbers for amino acid substitutions in the large fragment in the full length Bst DNA polymerase sequence, 295 should be added to the residue number.

The present invention in illustrative embodiments provides a non-naturally occurring, isolated mutant DNA polymerase that is typically a recombinant DNA polymerase, or a biologically active fragment thereof, as well as compositions, kits, and methods that include the mutant (e.g. recombinant) DNA polymerase or the biologically active fragment thereof, wherein the mutant polymerase has a polypeptide segment having at least 75%, 80%, 85%, 90%, 95%, 96%, 97%, 98%, or 99% sequence identity to SEQ ID NO: 1 or a fragment thereof, exhibits polymerase activity, and includes either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234K, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T. The mutant (e.g. recombinant) DNA polymerase can yield a lower error rate (e.g. average systematic error rate), improved accuracy, increased signal to noise ratio, and/or any of the specific properties demonstrated in the Examples provided herein, when used in a sequencing by synthesis reaction as compared to the average systematic error rate obtained using a reference Bst polymerase, such as wild-type Bst polymerase of SEQ ID NO: 1 or SEQ ID NO: 16, the mutant Bst polymerase of SEQ ID NO: 2 or SEQ ID NO: 122, the mutant Bst polymerase of SEQ ID NO: 35 or SEQ ID NO: 120, or any of the improved properties for these polymerases provided in the Examples herein. The sequencing by synthesis reaction in which the polymerase has improved properties in illustrative examples, is a sequencing reaction in which hydrogen ions are released and detected. The mutant (e.g. recombinant) polymerase includes amino acid substitutions H46R, E446Q, and H572R, in illustrative embodiments, and/or can include mutations H281M, D423K, and N487R, wherein the numbering is relative to SEQ ID NO: 1. In illustrative embodiments, the mutant (e.g. recombinant) DNA polymerase does not have 5' to 3' exonuclease activity and/or 3' to 5' exonuclease activity. In illustrative embodiments, the mutant (e.g. recombinant) DNA polymerase does not comprise segments of wild type Bst DNA polymerase having 3' to 5'exonuclease activity and/or 5' to 3' exonuclease activity. The improved properties yielded by the polymerases of the invention when used in an ion based sequencing reaction, can be, as non-limiting examples, measured and/or statistically significant improvements in one or more of average systematic error (ave SSE) or average AQ20 mean read length (MRL), key signal (as a measure of signal strength), perfect read length, average raw read accuracy, and true accuracy for homopolymer ACGT of 6 bp or 7 bp.

The mutant (e.g. recombinant) DNA polymerase in illustrative examples, includes one or more of L252R, H473G. and H528T, wherein the numbering is relative to SEQ ID NO: 1. Accordingly, in certain examples provided herein, the isolated mutant (e.g. recombinant) DNA polymerase has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T, wherein the numbering is relative to SEQ ID NO: 1. In an exemplary embodiment having such mutations, the non-naturally occurring mutant has the sequence of SEQ ID NO: 119.

In further subembodiments, the polypeptide segment of the isolated mutant (e.g. recombinant) DNA polymerase in the embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or can have at least 75%, 80%, 85%, 90%, 95%, 96%, 97%, 98%, or 99% identity to SEQ ID NO: 16. The mutant (e.g. recombinant) DNA polymerase in such subembodiments exhibits polymerase activity, includes, in illustrative subembodiments, amino acid substitutions H341R, E741Q, and H867R, and/or mutations H576M, D718K and N782R, and includes one or more of, L547R, H768G and H823T, wherein the numbering is relative to SEQ ID NO: 16. The mutant polymerase can have any of the improved properties provided in the Examples herein. For example, the isolated mutant (e.g. recombinant) polymerases provided herein can have a statistically significant reduction in systematic error and/or a systematic error rate that is between 5, 10, 15, 20, 25, 30, 35, 40, 45, or 50% on the low end of the range and 10, 15, 20, 25, 30, 35, 40, 45, 50, 60, 70, 75, 80, 85, or 90% on the high end of the range, lower than the average SSE obtained using a reference polypeptide such as SEQ ID NO: 1, SEQ ID NO: 2, SEQ ID NO: 35, SEQ ID NO: 16, SEQ ID NO: 120, or SEQ ID NO: 122. In illustrative embodiments, an isolated, mutant (e.g. recombinant) polymerase provided herein can has a statistically significant reduction in systematic error and/or a systematic error rate that is between 5, 10, 15, 20, and 25% on the low end of the range and 10, 15, 20, 25, 30, 35, 40, 45, and 50% on the high end of the range, lower than the average SSE obtained using SEQ ID NO: 35 as a reference polymerase. In illustrative examples for the above ranges, SSE is measured as percentage of stochastic errors in sequence motifs containing homopolymers of length 1-6, with systematic deletion occurring on strand with a frequency greater than 15%, when coverage (of the sequencing run) is equal to or greater than 20×. In some embodiment, the isolated mutant polymerase of the present invention has a mean read length (MRL) at average aq20 that is at least 5, 10 or 15 nucleotides longer, or between 5, 10, 15 or 25 nucleotides longer on the short end of the range, and 20, 25, 30, 40, 50, 60, 75, or 100 nucleotides longer on the high end of the range, longer than SEQ ID NO: 35, or SEQ ID NO: 120 especially for full length mutants; or 5, 10, 15, 20, 25, 30, 35, 40, 45, or 50% longer than SEQ ID NO: 35, or SEQ ID NO: 120 especially for full length mutants, or is between 5, 10, 15, 20, 25, 30, 35, and 40% longer than SEQ ID NO: 35, or SEQ ID NO: 120 on the low end of the range, and 10, 15, 20, 25, 30, 35, and 40, 45, or 50% longer than SEQ ID NO: 35, or SEQ ID NO: 120 for full length mutants, on the high end of the range. In some embodiments, the isolated mutant polymerase of the invention has a statistically significant increase in peak signal generated from that of a control polypeptide such as SEQ ID NO: 35, or has an increased peak signal of at least 5, 10, 15, or 20%, or between 5 and 10 on the low end of the range, and 10, 20, 25, 30, 40, or 50% on the high end of the range, compared to SEQ ID NO: 35, or SEQ ID NO: 120 for full length mutants. In certain illustrative embodiments, the mutant (e.g. recombinant) DNA polymerase includes L547R, H768G, and H823T (numbering according to SEQ ID NO: 16, although the polymerase can be a mutant 581 Bst polymerase fragment and longer, up to a mutant full length Bst polymerase), and can be 85%, 90%, 95%, 96%, 97%, 98%, or 99% identical to SEQ ID NO: 119 or SEQ ID NO: 121. In some of these embodiments, the isolated mutant polymerase has an accuracy for the homopolymer ACGT 6 bp of at least 80 or 85% or for a homopolymer of ACGT 6 bp or 7 bp that is statistically significantly greater than, or at least 5%, 10%, 15%, 20% or 25% greater than the accuracy obtained using SEQ ID NO: 35 or SEQ ID NO: 35 with L252R as a reference polymerase, or for full length, SEQ ID NO: 120 or SEQ ID NO: 120 with L547R as a reference. In an exemplary embodiment having such mutations and properties, the mutant DNA Polymerase has the amino acid sequence of SEQ ID NO: 121.

As indicated herein, the polypeptide segment of the mutant (e.g. recombinant) Bst DNA polymerase, can be at least 50%, 60%, 70%, 75%, 80%, 90%, 95%, 96%, 97%, 98%, 99%, or 100% of the mutant (e.g. recombinant) DNA polymerase. Accordingly, the mutant (e.g. recombinant) DNA polymerase can include the 581 amino acid fragment provided herein as the entire mutant (e.g. recombinant) DNA polymerase, or as a portion of the mutant polymerase. For example, the mutant polymerase can be a full-length Bst DNA polymerase that includes any of the mutant 581 amino acid Bst DNA polymerase fragments provided herein, or a mutant Bst DNA polymerase that includes any number of contiguous amino acids of wild-type Bst polymerase from the 876 amino acid full-length DNA polymerase added onto the mutant Bst DNA polymerase 581 amino acid fragment. To calculate the percent of a recombinant polypeptide that is a polypeptide segment, typically divide the number of amino acid residues in the segment by the number of amino acid residues in the entire mutant DNA polymerase. As explained in further detail herein, it is believed that such mutant Bst DNA polymerases that include the mutant 581 amino acid Bst DNA polymerase fragments provided herein and additional amino acids from full-length wild-type Bst DNA polymerase, will retain the improved properties demonstrated in the Examples herein for those mutant 581 amino acid Bst DNA polymerase fragments. Furthermore, such mutant Bst DNA polymerases can include additional sequences, such as 6X histidine sequences (SEQ ID NO: 123), or other purification tags. As such, the mutant Bst DNA polymerases provided herein can be fusion proteins.

In illustrative embodiments, the mutant (e.g. recombinant) polymerase includes additional amino acids from full-length Bst DNA polymerase, but does not include functional segments of wild-type Bst polymerase that possess 5' to 3' exonuclease activity and/or 3' to 5' exonuclease activity. Accordingly, in illustrative embodiments herein, the mutant Bst DNA polymerases do not have 5' to 3' exonuclease activity and/or 3' to 5' exonuclease activity. In illustrative embodiments, the mutant (e.g. recombinant) polymerase does not comprise segments of wild type Bst DNA polymerase having 3' to 5'exonuclease activity and/or 5' to 3' exonuclease activity.

In some embodiments, a mutant (e.g. recombinant) Bst DNA polymerase provided herein, includes the mutations indicated herein, but does not include the entire 581 amino acid fragment of Bst DNA polymerase. For example, such mutant Bst DNA polymerases can include 250, 300, 400, 500, 550, 560, 570, 575, 576, 577, 578, 579, or 580 contiguous amino acids of the mutant 581 amino acid Bst DNA polymerase fragments provided herein. In some embodiments, a biologically active fragment of a modified polymerase can include at least 25 contiguous amino acid residues of the catalytic domain or the DNA binding domain of Bst DNA polymerase.

In some embodiments, the disclosure generally relates to an optionally modified and typically recombinant, mutant DNA polymerase having at least 75%, 80%, 85%, 90%, 95%, 96%, 97%, 98%, or 99% identity to SEQ ID NO: 2, SEQ ID NO: 31, SEQ ID NO: 35, SEQ ID NO: 78, SEQ ID NO: 120, or SEQ ID NO: 122, or a fragment thereof, and includes one or more amino acid substitutions selected from the group consisting of (a) E325K, G504Q, P5311 or P531R, V546R, L547R, E515H or E515K or E515T, E540R, S555K, D559M, E562M or E562K or E562R, E572T, T619R, E620R, A639Y, E751R, E737R, E737Y, H768G, M790C, A787K, D775L, N780R, E788G, N812C or N812K, E817C, and H823T or (b) E325K, G504Q, N529K or N529R, P5311 or P531R, V536K, V546R, L547R, E515H or E515K or E515T, E540R, S555K, D559K or D559M, E562M or E562K or E562R, E572T, E589K, T619R, E620R, A639Y, E751R, E737R, E737Y, H768G, M790C, A787K, D775L, D775R, N780R, E788G or E788R, N812C or N812K, E817C, and H823T, where the numbering is relative to SEQ ID NO: 31, and where the recombinant DNA polymerase or fragment thereof yields improved accuracy and/or reduced systematic error rate as compared to SEQ ID NO: 2, SEQ ID NO: 31, SEQ ID NO: 35, SEQ ID NO: 78, SEQ ID NO: 120, or SEQ ID NO: 122, respectively. In certain illustrative an optionally modified, and typically recombinant, mutant polymerase of the present invention is a mutant Bst DNA polymerase that includes the 3 core buffering mutations H341R, E741Q, and H867R (position numbering relative to SEQ ID NO: 16). In other illustrative embodiments an optionally modified, and typically recombinant, mutant polymerase of the present invention includes the 3 core buffering mutations H341R, E741Q, and H867R (position numbering relative to SEQ ID NO: 16) as well as the mutations: H576M, D718K, N782R (position numbering relative to SEQ ID NO: 16).

In some embodiments, the disclosure generally relates to a recombinant DNA polymerase having at least 75%, 80%, 85%, 90%, 95%, 96%, 97%, 98%, or 99% identity to SEQ ID NO: 35 or a fragment thereof, and includes (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1, and where the recombinant DNA polymerase or fragment thereof yields improved accuracy and/or reduced systematic error rate as compared to SEQ ID NO: 35. In certain illustrative examples an optionally modified, and typically recombinant, mutant polymerase of the present invention is a mutant Bst DNA polymerase that includes the 3 core buffering mutations H46R, E446Q and H572R (position numbering relative to SEQ ID NO: 1). In other illustrative embodiments an optionally modified, and typically recombinant, mutant polymerase of the present invention includes the 3 core buffering mutations H46R, E446Q and H572R (position numbering relative to SEQ ID NO: 1) as well as the mutations: H281M, D423K, and N487R (position numbering relative to SEQ ID NO: 1).

In some embodiments, the disclosure generally relates to non-naturally occurring mutant (e.g. recombinant) DNA polymerase having at least 75%, 80%, 85%, 90%, 95%, 96%, 97%, 98%, or 99% identity to SEQ ID NO: 1 or a fragment thereof, exhibits polymerase activity, and includes either (a) one or more amino acid substitutions selected from the group consisting E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The recombinant DNA polymerase or fragment thereof yields improved accuracy and/or reduced systematic error rate as compared to SEQ ID NO: 1. The mutant (e.g. recombinant) polymerase can include amino acid substitutions H46R, E446Q, and H572R, in some embodiments, and/or can include mutations H281M, D423K, and N487R, wherein the numbering is relative to SEQ ID NO: 1.

In some embodiments, provided herein are methods, compositions, systems and kits that include the use of the recombinant, mutant polymerases of the present invention in nucleotide polymerization reactions, including nucleotide polymerization reactions wherein sequence information is obtained from a nucleic acid molecule. In some embodiments, provided herein is methods, compositions, systems and kits comprising the use of modified or recombinant polymerases in clonal amplification reactions, including nucleic acid library synthesis. In some embodiments, the disclosure relates to methods for using modified or recombinant polymerases in ion-based nucleic acid sequencing reactions, wherein sequence information is obtained from a template nucleic acid using an ion-based sequencing system. In some embodiments, provided herein are compositions, methods, systems, kits and apparatuses for carrying out a plurality of label-free DNA sequencing reactions (e.g., ion-based sequencing reactions) using a large-scale array of electronic sensors, for example field effect transistors ("FETs").

In some embodiments, the disclosure relates to methods for using mutant polymerases provided herein during amplification of nucleic acids in a sequencing reaction, wherein sequence information is obtained from the amplification of the nucleic acids using a solid support based sequencing system (e.g., bridge PCR based sequencing). In some embodiments, the disclosure generally relates to methods of amplifying one or more nucleic acids using a solid support system thereby clonally amplifying the nucleic acids on the solid support.

In another embodiment of the method the mutant polymerase or a biologically active fragment thereof has the amino acid sequence of SEQ ID NO: 80, SEQ ID NO: 83, SEQ ID NO: 84, SEQ ID NO: 85, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 105, SEQ ID NO: 106, SEQ ID NO: 107, SEQ ID NO: 108, SEQ ID NO: 109, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118 or SEQ ID NO: 119.

In another aspect of the invention, a method for performing a polymerization reaction is provided, that includes the following: (a) contacting a non-naturally occurring mutant (e.g. recombinant) DNA polymerase, or a biologically active fragment thereof, with a nucleic acid in the presence of one or more nucleotides; and (b) polymerizing at least one of the one or more nucleotides using the mutant (e.g. recombinant) DNA polymerase. The mutant (e.g. recombinant) DNA polymerase in such a method can include a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R, and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The recombinant polymerase used in such a method, can have the property, in illustrative embodiments, of yielding a lower systematic error rate and/or higher accuracy, when used in a sequencing by synthesis reaction as compared to a reference polymerase. The sequencing by synthesis reaction in illustrative examples is a reaction in which hydrogen ions are generated and detected. The mutant (e.g. recombinant) polymerase used in the method in illustrative embodiments, includes amino acid substitutions H46R, E446Q, and H572R, and/or can include mutations H281M, D423K, and N487R, wherein the numbering is relative to SEQ ID NO: 1. Salt can be included in a reaction mixture in which the contacting occurs. The reaction mixture can include the salt, for example at a concentration of between 50 and 250 mM, or between 100 mM and 200 mM, or between 120 and 200 mM, or in excess of 120 mM, such as between 125 mM and 250 mM, or between 125 mM and 175 mM. The salt in illustrative examples, is KCl and/or NaCl.

The mutant (e.g. recombinant) DNA polymerase in the method for performing a polymerization reaction provided above, in illustrative examples, includes one or more of L252R, H473G. and H528T, wherein the numbering is relative to SEQ ID NO: 1. Accordingly, in certain illustrative examples, provided herein the mutant (e.g. recombinant) DNA polymerase used in the method for performing a polymerization reaction has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T wherein the numbering is relative to SEQ ID NO: 1. In an exemplary embodiment having such mutations, the non-naturally occurring mutant (e.g. recombinant) DNA polymerase has the sequence of SEQ ID NO: 119.

In further subembodiments, the polypeptide segment of the mutant (e.g. recombinant) DNA polymerase in the method for polymerizing embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or at least 75%, 80%, 85%, 90%, 95%, 96%, 97%, 98%, or 99% identity to SEQ ID NO: 16. The mutant (e.g. recombinant) DNA polymerase in such methods for polymerizing subembodiments, exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain illustrative embodiments, the mutant (e.g. recombinant) DNA polymerase includes L547R, H768G, and H823T. In an exemplary method for polymerizing embodiment wherein the mutant (e.g. recombinant) DNA polymerase has such mutations, the mutant DNA Polymerase has the amino acid sequence of SEQ ID NO: 121.

In another aspect of the invention, a method for amplifying a nucleic acid is provided, that includes the following: (a) contacting a nucleic acid in the presence of one or more nucleotides, with a non-naturally occurring mutant (e.g. recombinant) DNA polymerase that includes a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The mutant (e.g. recombinant) polymerase used in such a method, has the property in illustrative embodiments, of yielding a lower systematic error rate and/or higher accuracy, when used in a sequencing by synthesis reaction as compared to a reference polymerase. The sequencing by synthesis reaction in illustrative examples is a reaction in which hydrogen ions are generated and detected. The mutant (e.g. recombinant) polymerase used in the method in illustrative examples, includes amino acid substitutions H46R, E446Q, and H572R, and/or can include mutations H281M, D423K, and N487R, wherein the numbering is relative to SEQ ID NO: 1. Salt can be included in a reaction mixture in which the contacting occurs. The reaction mixture can include a salt, for example at a concentration of between 50 and 250 mM, or between 100 mM and 200 mM, or between 120 mM to 200 mM, or between 120 and 200 mM, or in excess of 120 mM, such as between 125 mM and 250 mM, or between 125 mM and 175 mM. The salt in illustrative examples, is KCl and/or NaCl.

The mutant (e.g. recombinant) DNA polymerase in the method for amplifying a nucleic acid provided above, in illustrative examples includes one or more of L252R, H473G. and H528T, wherein the numbering is relative to SEQ ID NO: 1. Accordingly, in certain examples, provided herein the mutant DNA polymerase in the recombinant DNA polymerase and related embodiments has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T wherein the numbering is relative to SEQ ID NO: 1. In an exemplary embodiment having such mutations, the non-naturally occurring mutant has the sequence of SEQ ID NO: 119.

In further subembodiments, the polypeptide segment of the mutant (e.g. recombinant) DNA polymerase in the method for amplifying embodiments provided above, can be at least 50%, 60%, 70%, 75%, 80%, 90%, 95%, 96%, 97%, 98%, 99%, or 100% of the mutant (e.g. recombinant) DNA polymerase, and can have at least 75%, 80%, 85%, 90%, 95%, 96%, 97%, 98%, or 99% identity to SEQ ID NO: 1, or at least 75%, 80%, 85%, 90%, 95%, 96%, 97%, 98%, or 99% identity to SEQ ID NO: 16, which is full length wild-type Bst polymerase. The mutant (e.g. recombinant) DNA polymerase in such subembodiments exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary embodiment having such mutations, the mutant DNA Polymerase has the amino acid sequence of SEQ ID NO: 121

In certain embodiments, the method of amplifying is a polymerase chain reaction, an emulsion polymerase chain reaction, an isothermal amplification reaction, a recombinase polymerase amplification reaction, a proximity ligation amplification reaction, a rolling circle amplification reaction or a strand displacement amplification reaction. In certain embodiments, the amplification is clonally amplifying the nucleic acid in solution or on a solid support.

In a further aspect of the invention, a method for obtaining sequence information from a nucleic acid template is provided, that includes the following: (a) providing a reaction mixture comprising a template nucleic acid, a sequencing primer, one or more nucleotides, and a non-naturally occurring mutant (e.g. recombinant) DNA polymerase; (b) contacting the template nucleic acid with at least one type of nucleotide, wherein the contacting includes incorporating one or more nucleotides from the at least one type of nucleotide onto the 3' end of the sequencing primer and generating an extended primer product using the mutant (e.g. recombinant) DNA polymerase; and (c) detecting the presence of the extended primer product in the reaction mixture by detecting the generation and/or release of an ion such as a hydrogen ion or detection of a pyrophosphate or phosphate ion, thereby determining whether nucleotide incorporation has occurred. The mutant (e.g. recombinant) DNA polymerase in such a method can include a polypeptide segment having at least 80%, 85%, 90%, 95%, 96%, 97%, 98%, or 99% identity to SEQ ID NO: 1 or a fragment thereof, exhibits polymerase activity, can optionally include H46R, E446Q, and H572R, and/or H281M, D423K, and N487R, and includes either i) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 1; or ii) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1. The recombinant polymerase used in such a method, can in illustrative embodiments, yield a lower systematic error rate and/or higher accuracy, when used in a sequencing by synthesis reaction as compared to a reference polymerase. The sequencing by synthesis reaction in illustrative examples is a reaction in which hydrogen ions are generated and detected. The reaction mixture can include a salt, for example at a concentration of between 50 and 250 mM, or between 100 mM and 200 mM, or between 120 and 200 mM, or in excess of 120 mM, such as between 125 mM and 250 mM, or between 125 mM and 175 mM. The salt in illustrative examples, is KCl and/or NaCl. The method can be a high throughput sequencing method.

The mutant (e.g. recombinant) DNA polymerase in the method for obtaining sequence information from a nucleic acid template provided above, in illustrative examples, includes one or more of L252R, H473G. and H528T, wherein the numbering is relative to SEQ ID NO: 1. Accordingly, in certain examples, provided herein the mutant DNA polymerase in the recombinant DNA polymerase and related embodiments has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T, wherein the numbering is relative to SEQ ID NO: 1. In an exemplary embodiment of the method for obtaining sequence information, the mutant (e.g. recombinant) DNA polymerase having such mutations, has the sequence of SEQ ID NO: 119.

In further subembodiments of the method for obtaining sequence information from a nucleic acid template, the polypeptide segment of the mutant (e.g. recombinant) DNA polymerase in the embodiments provided above, can be at least 50%, 60%, 70%, 75%, 80%, 90%, 95%, 96%, 97%, 98%, 99% or 100% of the mutant (e.g. recombinant) DNA polymerase, and can have at least 75%, 80%, 85%, 90%, 95%, 96%, 97%, 98%, or 99% identity to SEQ ID NO: 1, or at least 75%, 80%, 85%, 90%, 95%, 96%, 97%, 98%, or 99% identity to SEQ ID NO: 16, which is full length wild-type Bst polymerase. The mutant (e.g. recombinant) DNA polymerase in such subembodiments exhibits polymerase activity, can include amino acid substitutions H341R, E741Q, and H867R, and/or can include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary of the method for obtaining sequence information, the mutant (e.g. recombinant) DNA polymerase having such mutations, has the amino acid sequence of SEQ ID NO: 121.

In certain embodiments of the method for obtaining sequence information from a nucleic acid template, the one or more nucleotides incorporated onto the 3' end of the sequencing primer are reversible terminator nucleotides.

In other embodiments of the method for obtaining sequence information from a nucleic acid template, the contacting includes generating one or more hydrogen ions as a by-product of nucleotide incorporation. Furthermore, in these or other embodiments, the detecting includes measuring a concentration of one or more hydrogen ions generated as a by-product of nucleotide incorporation. Furthermore, the method in these and other embodiments, can include identifying at least one of the one or more nucleotides incorporated from the at least one type of nucleotide. Furthermore, in these embodiments, the contacting, detecting and identifying steps can be repeated more than once, thereby identifying a plurality of sequential nucleotide incorporations.

In some embodiments, the mutant (e.g. recombinant) polymerase, or a biologically fragment therefore, is characterized by a change (e.g., increase or decrease) in any one or more of the following properties relative to a control or reference polymerase, which is a polymerase that does not include one or more of the mutations in the on-test polymerase: dissociation time constant, rate of dissociation of polymerase from a given nucleic acid template (also referred to herein as "off-rate"), binding affinity of the polymerase for a given nucleic acid template, average read length, minimum read length, accuracy, strand bias, raw read accuracy, systematic error, total sequencing throughput, performance in salt (i.e., ionic strength), AQ20, average error-free read length, 100Q17 value, 200Q17 value and processivity.

As used herein, the terms "Q17" or "Q20" and their variants, when used in reference to a given polymerase, refer to certain aspects of polymerase performance, particularly accuracy, in a given polymerase reaction, for example in a polymerase-based sequencing by synthesis reaction. For example, in a particular sequencing reaction, accuracy metrics can be calculated either through prediction algorithms or through actual alignment to a known reference genome. Predicted quality scores ("Q scores") can be derived from algorithms that look at the inherent properties of the input signal and make fairly accurate estimates regarding if a given single base included in the sequencing "read" will align. In some embodiments, such predicted quality scores can be useful to filter and remove lower quality reads prior to downstream alignment. In some embodiments, the accuracy can be reported in terms of a Phred-like Q score that measures accuracy on logarithmic scale such that: Q10=90%, Q17=98%, Q20=99%, Q30=99.9%, Q40=99.99%, and Q50=99.999%. Phred quality scores ("Q") are defined as a property which is logarithmically related to the base-calling error probabilities ("P"). Often the formula given for calculating "Q" is Q=10*log 10(1/error rate). In some embodiments, the data obtained from a given polymerase reaction can be filtered to measure only polymerase reads measuring "N" nucleotides or longer and having a Q score that passes a certain threshold, e.g., Q10, Q17, Q100 (referred to herein as the "NQ17" score). For example, the 100Q20 score can indicate the number of reads obtained from a given reaction that are at least 100 nucleotides in length and have Q scores of Q20 (99%) or greater. Similarly, the 200Q20 score can indicate the number of reads that are at least 200 nucleotides in length and have Q scores of Q20 (99%) or greater.

In some embodiments, the accuracy can also be calculated based on proper alignment using a reference genomic sequence, referred to herein as the "raw" accuracy. This is single pass accuracy, involving measurement of the "true" per base error associated with a single read, as opposed to consensus accuracy, which measures the error rate from the consensus sequence which is the result of multiple reads. Raw accuracy measurements can be reported in terms of "AQ" scores (for aligned quality). In some embodiments, the data obtained from a given polymerase reaction can be filtered to measure only polymerase reads measuring "N" nucleotides or longer having a AQ score that passes a certain threshold, e.g., AQ10, AQ17, AQ100 (referred to herein as the "NAQ17" score). For example, the 100AQ20 score can indicate the number of reads obtained from a given polymerase reaction that are at least 100 nucleotides in length and have AQ scores of AQ20 (99%) or greater. Similarly, the 200AQ20 score can indicate the number of reads that are at least 200 nucleotides in length and have AQ scores of AQ20 (99%) or greater.

In some embodiments, the accuracy of the polymerase, (including for example accuracy in a given sequencing reaction) can be measured in terms of the total number of "perfect" (i.e., zero-error) reads obtained from a polymerase reaction that are greater than 100, 200, 300, 400, 500, 750, 1000, 5000, 10000, 100000, or more nucleotides in length.

In some embodiments, the accuracy of the polymerase can be measured in terms of the longest perfect read (typically measured in terms of number of nucleotides included in the read) that is obtained from the polymerase reaction.

In some embodiments, the accuracy of the polymerase can be measured in terms of fold-increase in sequencing throughput obtained in a given sequencing reaction. For example, in some embodiments an exemplary recombinant polymerase of the instant application may have an increased accuracy of 2-fold, 5-fold, 10-fold, 20-fold, 50-fold, 75-fold, 100-fold, 150-fold, 200-fold, 400-fold, 500-fold, or greater, accuracy as compared to a reference polymerase.

Some exemplary non-limiting descriptions of accuracy metrics can be found in: Ewing B, Hillier L, Wendl M C, Green P. (1998): Base-calling of automated sequencer traces using phred. I. Accuracy assessment. Genome Res. 8(3): 175-185; Ewing B, Green P. (1998): Base-calling of automated sequencer traces using phred. II. Error probabilities. Genome Res. 8(3): 186-194; Dear S, Staden R (1992): A standard file format for data from DNA sequencing instruments. DNA Sequence, 3, 107-110; Bonfield J K, Staden R (1995): The application of numerical estimates of base calling accuracy to DNA sequencing projects. Nucleic Acids Res. 1995 Apr. 25; 23(8): 1406-10, herein incorporated by reference in their entireties.

In some embodiments, the sequencing accuracy of a given set of polymerases (including any of the mutant (e.g. recombinant) polymerases disclosed herein) can be measured in an ion-based sequencing reaction run where hydrogen ions are generated and detected; such accuracies can optionally be compared with each other to determine whether a given amino acid mutation increases or decreases the sequencing accuracy relative to a reference or unmodified polymerase. In some embodiments, the sequencing accuracy of one or more polymerases can be measured using any ion-based sequencing apparatus supplied by Ion Torrent Technologies (Ion Torrent Systems, Life Technologies, Carlsbad, Calif.), including for example the Ion Torrent PGM™ Sequencer (Ion Torrent Systems, Life Technologies, Part No. 4462917), optionally using the sequencing protocols and reagents provided by Ion Torrent Systems. Some examples of calculation of accuracy metrics of a given polymerase using such ion-based sequencing systems is described further in the Ion Torrent Application Note titled "Ion Torrent: Ion Personal Genome Machine™ Performance Overview, Performance Spring 2011", hereby incorporated by reference.

As used herein, the terms "dissociation rate constant" and "dissociation time constant", when used in reference to a given polymerase, refer to the time constant for dissociation ("koff") of a polymerase from a nucleic acid template under a defined set of reaction conditions. Some exemplary assays for measuring the dissociation time constant of a polymerase are described further below. In some embodiments, the dissociation time constant can be measured in units of inverse time, e.g., sec-1 or min-1.

In some embodiments, provided herein is an isolated recombinant polymerase including at least one amino acid modification relative to a reference polymerase and providing an increased average read length of primer extension products in a primer extension reaction using the recombinant polymerase, relative to the average read length of primer extension products obtained using the reference polymerase. In some embodiments, the isolated recombinant polymerase provides an increased average error-free read length of primer extension products in a primer extension reaction using the recombinant polymerase, relative to the average error-free read length of primer extension products obtained using the reference polymerase. Optionally, the recombinant polymerase includes two, three or more amino acid substitutions relative to the reference polymerase.

In some embodiments, the primer extension reaction is an ion-based sequencing reaction.

In some embodiments, the isolated recombinant polymerase provided herein provides an increased 100Q17 or 200Q17 value in a nucleic acid sequencing reaction (for example in an ion-based sequencing reaction) relative to the 100Q17 or 200Q17 value obtained using a reference polymerase, such as SEQ ID NO: 1, SEQ ID NO: 2, or SEQ ID NO: 35.

In some embodiments, the reference polymerase includes a naturally occurring or wild type polymerase. In other embodiments, the reference polymerase includes a derivative, truncated, mutant or variant form of a naturally occurring polymerase that is different from the recombinant polymerase, for example having one or more amino acid substitutions omitted as compared to the recombinant polymerase. In some embodiments, the reference polymerase is SEQ ID NO: 1, SEQ ID NO: 2, SEQ ID NO: 35, SEQ ID NO: 16, SEQ ID NO: 120, or SEQ ID NO: 122.

In some embodiments, provided herein is methods for performing a nucleotide polymerization reaction, comprising: contacting a recombinant polymerase with a nucleic acid template in the presence of one or more nucleotides; and polymerizing at least one of the one or more nucleotides using the recombinant polymerase. The polymerizing optionally further includes polymerizing the at least one nucleotide in a template-dependent fashion. In some embodiments, the recombinant polymerase includes one or more amino acid substitutions relative to a reference polymerase that does not include the one or more amino acid substitutions.

In some embodiments, the method further includes hybridizing a primer to the template prior to, during, or after the contacting. The polymerizing can include polymerizing the at least one nucleotide onto an end of the primer using the recombinant polymerase.

In some embodiments, the polymerizing is performed in the proximity of a sensor that is capable of detecting the polymerization of the at least one nucleotide by the recombinant polymerase.

In some embodiments, the method further includes detecting a signal indicating the polymerization of the at least one of the one or more nucleotides by the recombinant polymerase using the sensor.

The mutant (e.g. polymerase) provided herein, the reference polymerase, or both the recombinant polymerase of the present invention and the reference polymerase are typically a DNA polymerase. In illustrative embodiments, the DNA polymerase is mutant Bst DNA polymerase.

In some embodiments, a mutant (e.g. recombinant) polymerase or biologically active fragment thereof can be prepared using any suitable method or assay known to one of skill in the art. In some embodiments, any suitable method of protein engineering to obtain a recombinant polymerase or biologically active fragment thereof is encompassed by the disclosure. For example, site-directed mutagenesis is a technique that can be used to introduce one or more known or random mutations within a DNA construct. The introduction of the one or more amino acid mutations can be verified for example, against a standard or reference polymerase or via nucleic acid sequencing. Once verified, the construct containing the one or more of the amino acid mutations can be transformed into bacterial cells and expressed. A mutant polymerase can be generated using the nucleic acids and vectors provided herein. Examples 1 and 4 provide non-limiting exemplary methods for making mutant polymerases of the present invention.

Typically, colonies containing mutant expression constructs are inoculated in media, induced, and grown to a desired optical density before collection (often via centrifugation) and purification of the supernatant. It will be readily apparent to the skilled artisan that the supernatant can be purified by any suitable means. Typically, a column for analytical or preparative protein purification is selected. In some embodiments, a recombinant polymerase or biologically active fragment thereof prepared using the methods can be purified, without limitation, over a heparin column essentially according to the manufacturer's instructions.

Once purified, the optionally modified and typically recombinant, mutant polymerase or biologically active fragment thereof can be assessed using any suitable method for various polymerase activities. In some embodiments, the polymerase activity being assessed will depend on the application of interest. For example a polymerase used to amplify or sequence a nucleic acid molecule of about 400 bg in length may include polymerase activities such as increased processivity and/or increased dissociation time constant relative to a reference polymerase. In another example, an application requiring deep targeted-resequencing of a nucleic acid molecule of about 100 bg in length may include a polymerase with increased proofreading activity, increased raw accuracy, increased total sequencing throughout, decreased strand bias, lowered systematic error or increased minimum read length. In some embodiments, the one or more polymerase activities assessed can be related to polymerase performance or polymerase activity in the presence of high ionic strength solution (e.g., high salt conditions).

In some embodiments, an optionally modified, typically recombinant, mutant polymerase or biologically active fragment thereof prepared according to the methods herein can be assessed for DNA binding activity, nucleotide polymerization activity, primer extension activity, strand displacement activity, reverse transcriptase activity, 3'-5' exonuclease (proofreading) activity, and the like.

In some embodiments, a recombinant polymerase or biologically active fragment thereof prepared according to the methods herein can be assessed for increased accuracy, increase processivity, increased average read length, increased signal to noise ratio, increased signal, increased minimum read length, increased total sequencing throughput, reduced strand bias, lowered systematic error, increased AQ20, increased 200Q17 value or the ability to perform nucleotide polymerization as compared to a reference polymerase. In some embodiments, the recombinant polymerase or the biologically active fragment thereof can be assessed for any one of the polymerase activities in the presence of a high ionic strength solution. In some embodiments, the high ionic strength solution comprises 120 mM to about 300 mM salt. In some embodiments, the high ionic strength solution comprises a range of salt from between 120, 125, 130, or 135 mM on the low end, and 150, 175, 200, 225, 250, 300, 350, 400, or 500 mM on the high end. In one embodiment, the high ionic strength solution comprises at least 125 mM salt. In one embodiment, the high ionic strength solution comprises from 125 mM salt to 175 mM salt.

In some embodiments, a recombinant polymerase or biologically active fragment thereof is optionally characterized by a change (e.g., increase or decrease) in any one or more of the following properties (often, relative to a polymerase lacking the one or more amino acid mutations): dissociation time constant, rate of dissociation of polymerase from a given nucleic acid template, binding affinity of the polymerase for a given nucleic acid template, average read length, minimum read length, accuracy, total number of perfect reads, total sequencing throughput, strand bias, systematic error, fold-increase in throughput of a sequencing reaction, performance in salt (i.e., ionic strength), AQ20, average error-free read length, error-rate, 100Q17 value, 200Q17 value, Q score, raw read accuracy, signal, signal to noise, and processivity.

In some embodiments, a recombinant polymerase or biologically active fragment thereof can be assessed individually with respect to known values in the art for an analogous polymerase. In some embodiments, a recombinant polymerase or biologically active fragment thereof prepared according to the methods can be assessed against a known or reference polymerase under similar or identical conditions. In some embodiments, the conditions can include amplifying or sequencing a nucleic acid molecule in the presence of a high ionic strength solution. In some embodiments, the high ionic strength solution includes 120 mM to 300 mM salt. In one embodiment, the high ionic strength solution includes greater than 120 mM salt, such as between 125, 130, 140, or 150 mM salt on the low end of the range, and 150, 160, 170, 175, 180, 190, 200, 225, 250, 275, or 300 mM salt on the high end of the range.

In some embodiments, provided herein are methods for producing a plurality of recombinant polymerases or biologically active fragments. In some embodiments, provided herein are methods for producing a plurality of recombinant polymerases or biologically active fragments using a high-throughput or automated system. In some embodiments, the methods comprise mixing a plurality of recombinant polymerases or biologically active fragments with a series of reagents necessary for protein purification and extracting the purified polymerases or biologically active fragments from the mixture. In one example, a plurality of random or site-directed mutagenesis reactions can be prepared in a 96- or 384-well plate. Optionally, the contents of the 96- or 384-well plate can undergo an initial screen to identify polymerase mutant constructs. The contents of each individual well (or the contents of each well from an initial screen) can be delivered to a series of flasks, tubes or shakers for inoculation and induction. Once at the required optical density, the flask, tubes or shakers can be centrifuged and the supernatants recovered. Each supernatant can undergo protein purification, for example via fully automated column purification (for example see, Camper and Viola, Analytical Biochemistry, 2009, p 176-181). The purified recombinant polymerases or biologically active fragments can be assessed for one, or a combination of polymerase activities, such as DNA binding, primer extension, strand displacement, reverse transcriptase activity, and the like. It is envisaged that the skilled artisan can use the method (or variations of the methods that are within the scope of the disclosure) to identify a plurality of recombinant polymerases or biologically active fragments. In some aspects, the methods can be used to identify a plurality of recombinant polymerases or biologically active fragments that yield improved accuracy as compared to a reference polymerase. In some embodiments, the methods can be used to identify a plurality of recombinant polymerases or biologically active fragments thereof that yields improved accuracy in the presence of a high ionic strength solution as compared to a reference polymerase. In some embodiments, the high ionic strength solution can include a KCl and/or NaCl salt. In some embodiments, the high ionic strength solution can be 120 to 300 mM salt. In some embodiments, the high ionic strength solution can be 120 mM to 200 mM salt. In some embodiments, the high ionic strength solution can be from 125 mM to 175 mM salt. It will be apparent to the skilled artisan that various other suitable salts can be used in place, or in combination with KCl and/or NaCl. In some embodiments, the ionic strength solution can further include a sulfate.

As will be readily apparent to the skilled artisan, the disclosure outlines an exemplary automated and high-throughput method (and related apparatus and systems) to generate a library of recombinant polymerases or biological active fragments thereof. The disclosure also outlines methods (and related kits, compositions, apparatus and systems) to assess such recombinant polymerases or biologically active fragments thereof for polymerase activity. It is also encompassed by the disclosure that the skilled artisan can readily produce a mutagenized library of constructs wherein every amino acid within the polymerase of interest can be mutated. In some embodiments, a mutagenized library can be prepared wherein each amino acid within the polymerase is mutated by every possible amino acid combination. In some embodiments, a mutagenized library can be prepared where each amino acid within the polymerase is mutated, and where the combination of possible amino acid mutations is limited to conservative or non-conservative amino acid substitutions. In both examples, mutagenized libraries can be created containing vast numbers of mutant constructs that can be applied through an automated or high-throughput system for purification or for initial screening. In some embodiments, plates of 96- or 384-library constructs representing a mutagenized library can be assessed for one or more polymerase activities using an On-PGM polymerase screen, using a Personal Genome Machine and Ion PGM Sequencing Chips (Life Technologies Corp, CA). In one example, the On-PGM polymerase screen can include one or more 96- or 384-plates representing a mutagenized library; where each well of the plate consists of a different construct (recombinant polymerase) containing at least one, or more, amino acid mutations as compared to a reference polymerase in at least one well on the same plate (lacking the at least one or more amino acid mutations). In some embodiments, the reference polymerase acts as a control sample within the 96- or 384-plate to assess polymerase activity of each recombinant polymerase within the wells of the plate. In some embodiments, the library of constructs and reference polymerase within the plate can further include a unique barcode for each recombinant polymerase within the plate. Thus, a 96-well plate may contain 96 barcodes if each well in the plate contains either a reference polymerase or a recombinant polymerase construct. Once purified, the mutagenized library of proteins can be assessed for one, or a combination of polymerase activities, such as DNA binding, primer extension, strand displacement, reverse transcriptase, nick-initiated polymerase activity, raw accuracy, increase total sequencing throughput, reduced strand bias, lowered systematic error, read length and the like. In some embodiments, the libraries can further include template libraries that are known to perform well under the proposed amplification conditions, so that the well-performing template libraries can act as a baseline or control reading.

Optionally, the purified recombinant polymerases or biologically active fragments thereof can be further assessed for other properties such as the ability to amplify or sequence a nucleic acid molecule in the presence of high salt (ionic strength). The source or origin of the polymerase to be mutated is generally not considered critical. For example, eukaryotic, prokaryotic, archaeal, bacterial, phage or viral polymerases can be used in the methods. In some embodiments, the polymerase can be a DNA or RNA polymerase. In some embodiments, the DNA polymerase can include a family A or family B DNA polymerase. The exemplary methods provided herein are to be considered illustrative in view of the field of protein engineering and enzymatics and should not be construed as in any way limiting.

In some embodiments, the optionally modified, mutant and typically recombinant polymerase or a biologically active fragment thereof, having any of the mutations provided herein, includes one or more amino acid mutations that are located inside the catalytic domain of the recombinant polymerase. In some embodiments, the recombinant polymerase or biologically active fragment thereof can include at least 25, 50, 75, 100, 150, or more amino acid residues of the catalytic domain. In some embodiments, the recombinant polymerase or biologically active fragment thereof can include any part of the catalytic domain that comprises at least 25, 50, 75, 100, 150, or more contiguous amino acid residues. In some embodiments, the recombinant polymerase or biologically active fragment thereof can include at least 25 contiguous amino acid residues of the catalytic domain and can optionally include one or more amino acid residues at the C-terminal or the N-terminal that are outside the catalytic domain. In some embodiments, the recombinant polymerase or a biologically active fragment can include any 25, 50, 75, 100, 150, or more contiguous amino acid residues of the catalytic domain coupled to any one or more non-catalytic domain amino acid residues.

In some embodiments, the modified polymerase or a biologically active fragment thereof, includes one or more amino acid mutations that are located inside the DNA binding domain of the polymerase. In some embodiments, the modified polymerase or biologically active fragment thereof can include at least 25, 50, 75, 100, 150, or more amino acid residues of the DNA binding domain of the modified polymerase. In some embodiments, the modified polymerase or biologically active fragment thereof can include any part of the DNA binding domain that comprises at least 25, 50, 75, 100, 150, or more contiguous amino acid residues. In some embodiments, the modified polymerase or biologically active fragment thereof can include at least 25 contiguous amino acid residues of the binding domain and can optionally include one or more amino acid residues at the C-terminal or the N-terminal that are outside of the binding domain. In some embodiments, the modified polymerase or a biologically active fragment can include any 25, 50, 75, 100, 150 or more contiguous amino acid residues of the binding domain coupled to any one or more non-binding domain amino acid residues. In some embodiments, the modified polymerase (or biologically active fragment thereof) includes one or more amino acid mutations that are located inside the DNA binding domain of the modified polymerase, and wherein the polymerase has at least 80%, 85%, 90%, 95%, 96%, 97%, 98%, 99%, or more identity to any one of the modified polymerases disclosed herein.

In some embodiments, the modified polymerase or a biologically active fragment thereof, includes one or more amino acid mutations that are located outside the catalytic domain (also referred to herein as the DNA binding cleft) of the polymerase. The catalytic domains of the A family DNA polymerases, B family DNA polymerases and reverse transcriptases, as well as the RNA-dependent RNA polymerases are well known; all share a common overall structure and catalytic mechanism. The catalytic domains of all these polymerases have a shape that has been compared to a right hand and consists of "palm", "thumb" and "finger" domains. The palm domain typically contains the catalytic site for the phosphoryl transfer reaction. The thumb is thought to play a role positioning the duplex DNA and in processivity and translocation. The fingers interact with the incoming nucleotide as well as the template base with which it is paired. The palm domains are homologous in the A, B and RT families, but the arrangements of the fingers and thumb are different. The thumb domains of the different polymerase families do share common features, containing parallel or anti-parallel α-helices, with at least one α-helix interacting with the minor groove of the primer-template complex. The fingers domain also conserves an α-helix positioned at the blunt end of the primer-template complex. This helix contains highly conserved side chains (the B motif).

Three conserved motifs, A, B, and C have been identified for the A family polymerases. The A and C motifs are typically conserved in both the B family polymerases and the RT polymerases. (Delarue et al., Protein Engineering 3: 461-467 (1990)).

In some embodiments, for the A family polymerases, the A motif comprises the consensus sequence:

DXSXXE.            (SEQ ID NO: 5)

In some embodiments, for the A family polymerases, the B motif comprises the consensus sequence:

KXXXXXXYG          (SEQ ID NO: 6)

In some embodiments, for the A family polymerases, the C motif comprises the consensus sequence:

VHDE               (SEQ ID NO: 7)

In some embodiments, the polymerase optionally comprises any A family polymerase, or biologically active fragment, mutant, variant or truncation thereof, wherein the linking moiety is linked to any amino acid residue of the A family polymerase, or biologically active fragment mutant, variant or truncation thereof, that is situated outside the A, B or C motifs. In some embodiments, the linking moiety is linked to any amino acid residue of the A family polymerase, or biologically active fragment, that is situated outside the A motif, the B motif or the C motif.

The A and C motifs typically form part of the palm domain, and each motif typically contains a strictly conserved aspartic acid residue, which are involved in the catalytic mechanism common to all the DNA polymerases. DNA synthesis can be mediated by transfer of a phosphoryl group from the incoming nucleotide to the 3' OH of the DNA, releasing a polyphosphate moiety and forming a new DNA phosphodiester bond. This reaction is typically catalyzed by a mechanism involving two metal ions, normally Mg2+, and the two conserved aspartic acid residues.

In some embodiments, the conserved glutamic acid residue in motif A of the A family DNA polymerases plays an important role in incorporation of the correct nucleotide, as does the corresponding conserved tyrosine in B family members (Minnick et al., Proc. Natl. Acad. Sci. USA 99: 1194-1199 (2002); Parsell et al, Nucleic Acids Res. 35: 3076-3086 (2002). Mutations at the conserved Leu of motif A affect replication fidelity (Venkatesan et al., J. Biol. Chem. 281: 4486-4494 (2006)).

In some embodiments, the B motif contains conserved lysine, tyrosine and glycine residues. The B motif of *E coli* pol I has been shown to bind nucleotide substrates and contains a conserved tyrosine which has been shown to be in the active site.

In some embodiments, for the B family polymerases, the A motif comprises the consensus sequence:

DXXSLYPS.          (SEQ ID NO: 8)

In some embodiments, for the B family polymerases, the B motif comprises the consensus sequence:

KXXXNSXYG          (SEQ ID NO: 9)

In some embodiments, for the B family polymerases, the C motif comprises the consensus sequence:

YGDTDS             (SEQ ID NO: 10)

The residues in bold indicate invariant residues.

In some embodiments, the recombinant polymerase optionally comprises any B family polymerase, or biologically active fragment, mutant, variant or truncation thereof, wherein the linking moiety is linked to any amino acid residue of the B family polymerase, or biologically active fragment, mutant, variant or truncation thereof that is situated outside the A, B or C motifs. In some embodiments, the linking moiety is linked to any amino acid residue of the B family polymerase, or biologically active fragment, that is situated outside the A motif, the B motif or the C motif.

In some embodiments, the B family polymerases contain six conserved motifs, of which regions I and II correspond to the A and C motifs of the A family. Region III is involved in nucleotide binding and is functionally homologous to motif B. Regions I, II and III converge at the center of the active site from the palm (I), the fingers (II), and base of the thumb (III) to produce a contiguous conserved surface. Within these regions, a set of highly conserved residues form three chemically distinct clusters consisting of exposed aromatic residues, negatively charged residues, and positively charged residues, respectively. For example, in the replication polymerase of the bacteriophage RB69, these three clusters corresponds to the following amino acid residues: Y416, Y567, and Y391 (exposed aromatic residues), D621, D623, D411, D684, and E686 (negatively charged residues), and K560, R482, and K486 (positively charged residues). See Wang et al, Cell 89: 1087-1099 (1997). These three clusters typically encompass the region in which the primer terminus and the incoming nucleotide would be expected to bind. In some embodiments, the recombinant polymerase optionally comprises any B family polymerase, or biologically active fragment, mutant, variant or truncation thereof, wherein the linking moiety is linked to any amino acid residue of the B family polymerase, or biologically active fragment, mutant, variant or truncation thereof that is situated outside one or more of these conserved amino acid clusters or motifs. In some embodiments, the linking moiety is linked to any amino acid residue of the B family polymerase, or biologically active fragment, mutant, variant or truncation thereof that is situated outside any of these conserved amino acid clusters or motifs.

The RT polymerases contain four conserved sequence motifs (Poch et al., EMBO J. 12: 3867-3874 (1989)), with motifs A and C containing the conserved catalytic aspartates. The integrity of motif B is also required for reverse transcriptase function.

```
                                             (SEQ ID NO: 11)
The consensus sequence for motif A is DXXXXF/Y (SEQ ID NO: 12)
The consensus sequence for motif B is FXGXXXS/A (SEQ ID NO: 13)
The consensus sequence for motif C is YXDD (SEQ ID NO: 14)
The consensus sequence for motif D is GXXXXXXXK.
```

Mutations in the YXDD motif (SEQ ID NO: 13) (motif C), the most highly conserved of these motifs, can abolish polymerase activity and alter the processivity and fidelity (Sharma et al., Antiviral Chemistry and Chemotherapy 16: 169-182 (2005)). In addition, the conserved lysine residue in motif D, a loop that is unique to the RT polymerases, is an invariant residue important for nucleotide binding (Canard et al., J. Biol. Chem. 274: 35768-35776 (1999)).

In some embodiments, the recombinant polymerase optionally comprises any RT polymerase, or biologically active fragment, mutant, variant or truncation thereof, wherein the linking moiety is linked to any amino acid residue of the RT polymerase, or biologically active fragment, mutant, variant or truncation thereof that is situated outside one or more of the A, B, C and D motifs. In some embodiments, the linking moiety is linked to any amino acid residue of the RT polymerase, or biologically active fragment, mutant, variant or truncation thereof that is situated outside any of these motifs.

In some embodiments, the recombinant polymerase includes one or more modifications (including amino acid substitutions, deletions, additions or chemical modifications) located at any position other than at the conserved or invariant residues.

In some embodiments, in addition to the polymerase domains, the mutant (e.g. recombinant) DNA polymerase with any of the mutations provided herein, or analogous mutations if such polymerase is not based on the sequence of wild-type Bst DNA polymerase, can include one or more additional functional domains, including domains required for 3'→5' (reverse) exonuclease activity that mediates proofreading of the newly synthesized DNA strand, or for 5'→3' (forward) exonuclease activity that mediates nick translation during DNA repair, or for FLAP endonuclease activity. In some embodiments, the recombinant polymerase has strand-displacing activity, and can catalyze nucleic acid synthesis by polymerizing nucleotides into the 3' end of a nick within a double stranded nucleic acid template while simultaneously displacing the nucleic acid located downstream of the nick. The recombinant polymerase optionally has any one or more of these activities as well.

The 3' to 5' exonuclease proofreading domains of both A and B family DNA polymerases contain three conserved motifs, called Exo I, Exo II and Exo III, each of which contains an invariant aspartic acid residue essential for metal binding and exonuclease function. Alterations of these conserved aspartic acid residues result in proteins which retain polymerase activity, but are deficient in exonuclease activity (Hall et al., J. Gen. Virol. 76: 2999-3008 (1995)). Conserved motifs in the 5' to 3' exonuclease domains and amino acid alterations that affect exonuclease activity have also been identified (U.S. Pat. No. 5,466,591).

Representative examples of A family enzymes are *E. coli*. Pol I, or the Klenow fragment of *E. coli*. Pol I, Bst DNA polymerase, Taq DNA polymerase, T7 DNA polymerase and Tth DNA polymerase. A family enzymes also include the Platinum Taq DNA polymerase series.

In some embodiments, the A family enzymes are characterized by high DNA elongation rates but can have poor fidelity because of the lack of 3'-5' exonuclease activity. In some embodiments, the B family enzymes can have high fidelity owing to their 3'-5' exonuclease activity but can achieve low DNA elongation rates.

In some embodiments, the recombinant polymerase is derived from the Bst DNA polymerase of Bacillus stearothermophilus, or any biologically active fragment thereof. The Bst polymerase can be a family A DNA polymerase. The 581 amino acid fragment, sometimes referred to herein as the "large fragment," of the naturally occurring Bst DNA polymerase is equivalent to the Klenow fragment of *E. coli* Pol I, retaining the polymerase and proofreading exonuclease activities while lacking the 5' to 3' exonuclease activity. In some embodiments, the polymerase derived from Bst DNA polymerase can lack 3' to 5' exonuclease activity. As used herein, the term "Bst DNA polymerase" may refer to a full length protein or to a Bst large fragment.

In some embodiments, the reference polymerase, the recombinant polymerase or both the reference and recombinant polymerase consist of, or comprise, an isolated variant of a Bst DNA polymerase having, or comprising, the amino acid sequence of SEQ ID NO: 1, which is the amino acid sequence of the large fragment (C-terminal portion) of the Bst DNA polymerase.

SEQ ID NO: 1 corresponds to the large fragment of Bst DNA polymerase and includes the DNA polymerase motifs A, B, and C (see, e.g., Delarue, supra) at residues 358-363, 411-420 and 533-536, respectively. In some embodiments, to retain the polymerase activity of a Bst polymerase, any substitutions, deletions or chemical modifications can be made to amino acid residues that are not highly conserved within motifs A, B or C, such as the invariant aspartic acid residues D358 and D535 required for polymerase activity, provided that such mutant Bst DNA polymerases include the mutations identified herein. In some embodiments, the recombinant polymerase includes a mutant or variant form of a Bst DNA polymerase that retains a detectable level of polymerase activity.

In some embodiments, the reference polymerase, the recombinant polymerase or both the reference and recombinant polymerase consists of or comprises an isolated variant of a polymerase having or comprising an amino acid sequence that is at least 80% identical to the amino acid sequence of SEQ ID NO: 1. In some embodiments, the reference polymerase or the recombinant polymerase is an isolated variant of a Bst DNA polymerase comprising the amino acid sequence of SEQ ID NO: 1, wherein the variant comprises an amino acid sequence that is at least 80%, at least 85%, at least 90%, at least 91%, at least 92%, at least 93%, at least 94%, at least 95%, at least 96%, at least 97%, at least 98%, or at least 99% identical to SEQ ID NO: 1.

In some embodiments, the reference polymerase is a Bst DNA polymerase having, or comprising, the amino acid sequence of SEQ ID NO: 1, and the recombinant polymerase further includes one or more amino acid modifications (e.g., amino acid substitutions, deletions, additions or chemical modifications) relative to the reference polymerase. In some embodiments, the reference polymerase, the recombinant polymerase, or both the reference and recombinant polymerases include a deletion or substitution of the methionine residue at position 1, wherein the numbering is relative to the amino acid sequence of SEQ ID NO: 1.

In some embodiments, the reference polymerase and/or the recombinant polymerase can include the amino acid sequence of any biologically active fragment of a polymerase having or comprising the amino acid sequence of SEQ ID NO: 1. In some embodiments, the recombinant polymerase can include the amino acid sequence of any biologically active fragment of a polymerase having or comprising an amino acid sequence that is at least 90%, at least 91%, at least 92%, at least 93%, at least 94%, at least 95%, at least 96%, at least 97%, at least 98%, or at least 99% identical to the amino acid sequence of SEQ ID NO: 1.

In some embodiments, the recombinant polymerase consists of or comprises an isolated variant of a Bst DNA polymerase having or comprising the amino acid sequence of SEQ ID NO: 2.

SEQ ID NO: 2 includes three amino acid substitutions relative to SEQ ID NO: 1, namely: His46Arg (H46R), Glu446Gln (E446Q), and His572Arg (H572R), wherein the numbering is relative to the amino acid sequence of SEQ ID NO: 1.

In some embodiments, the recombinant polymerase consists of or comprises an isolated variant of a polymerase having or comprising an amino acid sequence that is at least 90% identical to the amino acid sequence of SEQ ID NO: 2.

In some embodiments, the polymerase is a variant of a Bst DNA polymerase comprising the amino acid sequence of SEQ ID NO: 2, wherein the variant comprises an amino acid sequence that is at least 80%, at least 85%, at least 90%, at least 91%, at least 92%, at least 93%, at least 94%, at least 95%, at least 96%, at least 97%, at least 98%, or at least 99% identical to SEQ ID NO: 2.

In some embodiments, the reference polymerase is a Bst DNA polymerase having, or comprising, the amino acid sequence of SEQ ID NO: 2, and the recombinant polymerase further includes one or more amino acid modifications (e.g., amino acid substitutions, deletions, additions or chemical modifications) relative to the reference polymerase. In some embodiments, the reference polymerase, the recombinant polymerase, or both the reference and recombinant polymerases include a deletion or substitution of the methionine residue at position 1, wherein the numbering is relative to the amino acid sequence of SEQ ID NO: 2.

SEQ ID NO: 35 includes three amino acid substitutions relative to SEQ ID NO: 2, namely D423K, N487R and H281M, where the numbering is relative to the amino acid sequence of SEQ ID NO: 2. This sequence is a base sequence for illustrative Bst DNA polymerases provided herein. As such, exemplary embodiments of non-naturally occurring Bst DNA polymerases provided herein have at least 75%, 80%, 85%, 90%, 95%, 96%, 97%, 98%, or 99% sequence identity to SEQ ID NO: 35 or a fragment thereof, exhibit polymerase activity, and include either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T. The mutant (e.g. recombinant) DNA polymerases can yield a lower average systematic error rate when used in a sequencing by synthesis reaction as compared to the average systematic error rate, or yields improved accuracy when used in a sequencing by synthesis reaction as compared to the mutant Bst DNA polymerase of SEQ ID NO: 35. The sequencing by synthesis reaction in which the polymerase has improved properties in illustrative examples, is a sequencing reaction in which hydrogen ions are released and detected.

In some embodiments, a biologically active fragment provided herein for any of the mutant Bst DNA polymerases can include any part of the DNA binding domain or any part of the catalytic domain of the modified polymerase. In some embodiments, the biologically active fragment can optionally include any 25, 50, 75, 100, 150 or more contiguous amino acid residues of the DNA binding or catalytic domain of any of the mutant DNA polymerases provided herein. In some embodiments, a biologically active fragment of the modified polymerase can include at least 25 contiguous amino acid residues of the catalytic domain or the DNA binding domain having at least 80%, 85%, 90%, 95%, 98%, or 99% identity to any one or more of the polymerases encompassed by the disclosure, in illustrative embodiments SEQ ID NO: 119 or SEQ ID NO: 121.

In some embodiments, provided herein are compositions that include a recombinant and/or mutant polymerase of SEQ ID NO: 16, or a fragment thereof having polymerase activity and having 25, 50, 75, 100, 150, 200, 250, 300, 400, 500, 600, 700, 750, 800, 850, 860, 870, 871, 872, 873, 874, or more, contiguous amino acid residues of SEQ ID NO: 16, wherein the polymerase or fragment thereof, includes at least one amino acid substitution selected from V536K, G504Q, N529K, N529R, P531I, P531R, L547R, E515H, E515K, E515T, S555K, T619R, E562M, E562K, E562R, E572T, E589K, E751R, E788G, E788R, E737R, E737Y, M790C, E620R, A787K, D775L, D775R, A639Y, E540R, E325K, N812C, N812K, V546R, N780R, E817C, D559K, D559M, H823T and H768G (such mutations collectively known herein as the "Advantageous Mutations" of the full-length polymerase), wherein the numbering is relative to SEQ ID NO: 16. In illustrative embodiments, the recombinant and/or mutant polymerase includes H341R+E741Q+H867R and further optionally includes H576M+D718K+N782R.

In some embodiments, the composition includes a fragment of SEQ ID NO: 35 having polymerase activity, including 25, 50, 75, 100, 150, 200, or more, contiguous amino acid residues of SEQ ID NO: 35, and further including at least one amino acid substitution selected from the group consisting of V241K, G209Q, N234K or N234R, P236I or P236R, L252R, E220H or E220K or E220T, S260K, T324R, E267M or E267K or E267R, E277T, E294K, E456R, E493G or E493R, E442R or E442Y, M495C, E325R, A492K, D480L or D480R, A344Y, E245R, E30K, N517C or N517K, V251R, N485R, E522C, D264K or D264M, H528T and H473G, wherein the numbering is relative to SEQ ID NO: 35. The composition typically exhibits polymerase activity.

In some embodiments, the recombinant modified polymerase consists of or comprises an isolated variant of a polymerase having or comprising an amino acid sequence that is at least 90% identical to the amino acid sequence of SEQ ID NO: 35. In some embodiments, the polymerase is a variant of a Bst DNA polymerase comprising the amino acid sequence of SEQ ID NO: 35, wherein the variant comprises an amino acid sequence that is at least 80%, at least 85%, at least 90%, at least 91%, at least 92%, at least 93%, at least 94%, at least 95%, at least 96%, at least 97%, at least 98%, or at least 99% identical to SEQ ID NO: 35 and SEQ ID NO: 35 variants that includes one or more amino acid substitutions selected from the group consisting of E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 1.

In some embodiments, the reference polymerase is a Bst DNA polymerase having, or comprising, the amino acid sequence of SEQ ID NO: 35 and the recombinant polymerase further include one or more amino acid modifications (e.g., amino acid substitutions, deletions, additions or chemical modifications) relative to the reference polymerase. In some embodiments, the reference polymerase, the recombinant polymerase, or both the reference and recombinant polymerases include a deletion or substitution of the methionine residue at position 1, wherein the numbering is relative to the amino acid sequence of SEQ ID NO: 2.

In some embodiments, provided herein is a recombinant polymerase that includes an isolated variant of a Bst DNA polymerase comprising an amino acid sequence selected from the group consisting of SEQ ID NO: 31, and SEQ ID NO: 35, and further including one or more amino acid mutations. Optionally, the recombinant polymerase includes one, two, three, four or more amino acid substitutions relative to the amino acid sequence of SEQ ID NO: 31 and SEQ ID NO: 35.

The recombinant polymerase can further include any one or more amino acid mutations selected from the group consisting of: H46R, C93R, Q238C, H273R, H281A, E446Q, H473R, Y477F, H528A, C550Q, H572R, E220K, N234R, A263K, D264A, D264R, H273N, H281M, D423K, D480R, N485K, N487R, E493R, H528F and H528S, wherein the numbering is relative to the amino acid sequence of SEQ ID NO: 1. The recombinant polymerase has a reduced buffering capacity relative to the reference polymerase. Without being bound to any particular theory of operation, it can be observed that one or more of the aforementioned mutations can alter, e.g., increase or decrease the buffering capacity of the modified polymerase relative to the unmodified polymerase. Such mutations can therefore be referred to as "buffering" mutations.

In some embodiments, such increase or decrease in buffering capacity can increase the observed signal in an ion-based sequencing reaction. Further information about such mutations and their possible effect on the buffering capacity of the polymerase can be found, for example, in U.S. Provisional Appl. No. 60/308,863 filed Feb. 26, 2010; U.S. patent application Ser. No. 13/035,081 filed Feb. 25, 2011; Ser. No. 13/035,177 filed Feb. 25, 2011; Ser. No. 13/036,526 filed Feb. 28, 2011; and Ser. No. 13/036,623 filed Feb. 25, 2011; as well as in International PCT Appl. Nos. PCT/US2011/026219 filed Feb. 25, 2011; PCT/US2011/026228 filed Feb. 25, 2011; PCT/US2011/026450 filed Feb. 28, 2011; and PCT/US2011/026468 filed Feb. 28, 2011; all of which aforementioned applications are hereby incorporated by reference in their entireties.

In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. Optionally, the reference polymerase, the recombinant polymerase, or both the reference and recombinant polymerases can further include one or more amino acid mutations that decrease or eliminate exonuclease activity. Some exemplary mutations that can reduce or eliminate the exonuclease activity of the polymerase are described further herein.

In some embodiments, the reference polymerase has or comprises the amino acid sequence of SEQ ID NO: 1, SEQ ID NO: 2, SEQ ID NO: 3, SEQ ID NO: 4, SEQ ID NO: 33, SEQ ID NO: 34, SEQ ID NO: 35, SEQ ID NO: 36 or SEQ ID NO: 37 and the recombinant polymerase has or comprises the amino acid sequence of the reference polymerase, further including one or more amino acid mutations as compared to the reference polymerase. In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. In some embodiments, the recombinant polymerase further includes one or more amino acid substitutions at any one or more positions selected from the group consisting of: 46, 93, 220, 234, 238, 263, 264, 273, 281, 423, 446, 473, 477, 480, 485, 487, 493, 528, 550 and 572, wherein the numbering is relative of the amino acid sequence of SEQ ID NO: 1. In some embodiments one or more of the aforementioned amino acid substitutions can alter, e.g., increase or decrease the buffering capacity of the modified polymerase relative to the corresponding reference polymerase having the amino acid sequence of SEQ ID NO: 1, SEQ ID NO: 2, SEQ ID NO: 3 SEQ ID NO: 4 SEQ ID NO: 34, SEQ ID NO: 35, or SEQ ID NO: 37. Such mutations can therefore be referred to as "buffering" mutations. In some embodiments, such increase or decrease in buffering capacity can increase the observed signal in an ion-based sequencing reaction. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. In some embodiments, the recombinant polymerase exhibits a change in any one or more parameters selected from the group consisting of: average read length, accuracy, total sequencing throughout, strand bias, lowered systematic error, minimum read length, enhanced performed in higher ionic strength solution, improved processivity, performance in polymerase chain reaction, performance in emulsion polymerase chain reaction, buffering capacity, off-rate, dissociation time constant, AQ20, 00Q17 value and 200Q17 value, relative to the reference polymerase. Optionally, the change is observed by comparing the performance of the reference and recombinant polymerases in an ion-based sequencing reaction. Optionally, the reference polymerase, the modified polymerase, or both the reference and modified polymerases can further include one or more amino acid mutations that decrease or eliminate exonuclease activity.

In some embodiments a recombinant polymerase including one or more of these mutations exhibits an altered (e.g., increased or decreased) binding affinity for a nucleic acid template relative to the corresponding unmodified polymerase or to a reference polymerase. In some embodiments, the recombinant polymerase has an altered (e.g., increased or decreased) rate of dissociation from the nucleic acid template ("off-rate") relative to the unmodified polymerase or to a reference polymerase. In some embodiments, the recombinant polymerase exhibits an altered, e.g., increased or decreased read length, or an altered average error-free read length, or altered (e.g., increased or decreased) observed 100Q17 or 200Q17 values relative to the reference polymerase. In some embodiments, the recombinant polymerase exhibits a change in any one or more of the following kinetic parameters: average read length, minimum read length, enhanced performed in higher ionic strength solution, improved processivity, performance in polymerase chain reaction, performance in emulsion polymerase chain reaction, dissociation time constant, off-rate, AQ20, 100Q17 value, and 200Q17 value, relative to the reference polymerase. Optionally, the change is observed by comparing the performance of the reference and recombinant polymerases in an ion-based sequencing reaction. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. In some embodiments, the recombinant polymerase exhibits a change in any one or more parameters selected from the group consisting of: average read length, minimum read length, enhanced performed in higher ionic strength solution, improved processivity, performance in polymerase chain reaction, performance in emulsion polymerase chain reaction, buffering capacity, off-rate, 100Q17 value, AQ20 and 200Q17 value, relative to the reference polymerase. Optionally, the change is observed by comparing the performance of the reference and recombinant polymerases in an ion-based sequencing reaction. Optionally, the reference polymerase, the recombinant polymerase, or both the reference and recombinant polymerases can further include one or more amino acid mutations that decrease or eliminate exonuclease activity.

In some embodiments, the reference polymerase has or comprises the amino acid sequence of SEQ ID NO: 2, SEQ ID NO: 35, SEQ ID NO: 119, and includes one or more amino acid substitutions selected from the group consisting of E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T and the recombinant polymerase has or comprises the amino acid sequence of the reference polymerase and further includes at least one amino acid substitution relative to the reference polymerase. In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. In some embodiments, the recombinant polymerase further includes amino acid substitutions at any one or more positions selected from the group consisting of: 31, 46, 77, 93, 113, 114, 130, 144, 212, 220, 234, 238, 241, 251, 252, 263, 264, 272, 273, 280, 281, 294, 299, 303, 331, 325, 335, 336, 354, 370, 409, 416, 418, 420, 423, 425, 428, 429, 446, 448, 457, 462, 473, 477, 480, 485, 487, 488, 493, 495, 528, 533, 550, 572, 577 and 579, wherein the numbering is relative of the amino acid sequence of SEQ ID NO: 1. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. In some embodiments, the recombinant polymerase exhibits a change in any one or more parameters selected from the group consisting of: binding affinity for a nucleic acid template, buffering capacity, average read length, minimum read length, enhanced performed in higher ionic strength solution, improved processivity, performance in polymerase chain reaction, performance in emulsion polymerase chain reaction, AQ20, dissociation time constant, off-rate, 100Q17 value and 200Q17 value, relative to the reference polymerase. Optionally, the change is observed by comparing the performance of the reference and recombinant polymerases in an ion-based sequencing reaction. Optionally, the reference polymerase, the recombinant polymerase, or both the reference and recombinant polymerases can further include one or more amino acid mutations that decrease or eliminate exonuclease activity.

Without being bound to any particular theory of operation, it can be observed that in some embodiments a recombinant polymerase including one or more of these mutations exhibits an altered (e.g., increased or decreased) binding affinity for a nucleic acid template relative to an unmodified polymerase, or an altered (e.g., increased or decreased) rate of dissociation from the nucleic acid template ("off-rate") relative to the unmodified polymerase. In some embodiments, the recombinant polymerase exhibits an altered (e.g., increased or decreased) buffering capacity relative to the unmodified polymerase. In some embodiments, the recombinant polymerase exhibits an altered, e.g., increased or decreased read length, or an altered average error-free read length, or altered dissociation time constant, or altered (e.g., increased or decreased) observed 100Q17 or 200Q17 values relative to the reference polymerase. In some embodiments, the recombinant polymerase exhibits an altered, e.g., increased or decreased read length, or an altered average error-free read length, or altered (e.g., increased or decreased) observed 100Q17 or 200Q17 values relative to the reference polymerase. In some embodiments, the recombinant polymerase exhibits a change in any one or more parameters selected from the group consisting of: buffering capacity, off-rate, average read length, minimum read length, raw accuracy, total sequencing throughput, systematic error, strand bias, enhanced performed in higher ionic strength solution, improved processivity, performance in polymerase chain reaction, performance in emulsion polymerase chain reaction, AQ20, 100Q17 value and 200Q17 value, relative to the reference polymerase. Optionally, the change is observed by comparing the performance of the reference and recombinant polymerases in an ion-based sequencing reaction. In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. Optionally, the reference polymerase, the recombinant polymerase, or both the reference and recombinant polymerases can further include one or more amino acid mutations that decrease or eliminate exonuclease activity.

In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. In some embodiments, the recombinant polymerase further includes amino acid substitutions at any one or more positions selected from the group consisting of: 46, 93, 238, 252, 273, 281, 446, 473, 477, 528, 550 and 572, as well as one or more amino acid substitutions selected from the group consisting of 31, 77, 113, 114, 130, 144, 212, 220, 234, 241, 251, 263, 264, 272, 280, 294, 299, 303, 331, 325, 335, 336, 354, 370, 409, 416, 418, 420, 423, 425, 428, 429, 448, 457, 462, 480, 485, 487, 488, 493, 495, 533, 577 and 579, wherein the numbering is relative of the amino acid sequence of SEQ ID NO: 1. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the recombinant polymerase, or both the reference and recombinant polymerases can further include a deletion of the methionine residue at position 1, or a substitution of the methionine residue at position 1 with any other amino acid residue, wherein the numbering is relative to the amino acid sequence of SEQ ID NO: 1. In some embodiments, the recombinant polymerase exhibits a change in any one or more parameters selected from the group consisting of: binding affinity for a nucleic acid template, buffering capacity, average read length, minimum read length, raw accuracy, total sequencing throughput, systematic error, strand bias, enhanced performed in higher ionic strength solution, improved processivity, performance in polymerase chain reaction, performance in emulsion polymerase chain reaction, AQ20, dissociation time constant, off-rate, 100Q17 value and 200Q17 value, relative to the reference polymerase. Optionally, the change is observed by comparing the performance of the reference and recombinant polymerases in an ion-based sequencing reaction. Optionally, the reference polymerase, the recombinant polymerase, or both the reference and recombinant polymerases can further include one or more amino acid mutations that decrease or eliminate exonuclease activity.

In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of any of SEQ ID NOs: 38-78 or SEQ ID NOS: 120-122.

In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of any of SEQ ID NOS: 79-119.

In some embodiments, the one or more mutations in the recombinant polymerase can include at least one amino acid substitution. In some embodiments, the at least one amino acid substitution can optionally occur at any one or more positions selected from the group consisting of 46, 220, 234, 252, 263, 264, 273, 281, 423, 446, 473, 477, 480, 485, 487, 493, 528 and 572, wherein the numbering is relative to the amino acid sequence of SEQ ID NO: 1. In some embodiments, the recombinant polymerase includes at least two, three, four, five, or more amino acid substitutions occurring at positions selected from this group. Without intending to be bound to any particular theory of action, it can be observed that in some embodiments, amino acid substitution at such positions can alter, e.g., increase or decrease the buffering capacity of the modified polymerase relative to the corresponding unmodified polymerase, or relative to a reference polymerase. Such mutations can therefore be referred to as "buffering" mutations. In some embodiments, such increase or decrease in buffering capacity can increase the observed signal in an ion-based sequencing reaction.

In some embodiments, the one or more mutations in the recombinant polymerase can include at least one amino acid substitution. The at least one amino acid substitution can optionally occur at any one or more positions selected from the group consisting of: 31, 77, 113, 114, 130, 144, 212, 220, 234, 241, 251, 264, 272, 280, 294, 299, 303, 331, 325, 335, 336, 354, 370, 409, 416, 418, 420, 423, 425, 428, 429, 448, 457, 462, 480, 485, 487, 488, 493, 495, 533, 577 and 579, wherein the numbering is relative to the amino acid sequence of SEQ ID NO: 1. In some embodiments, the at least one amino acid substitution can optionally occur at any one or more positions selected from the group consisting of 536, 504, 529, 531, 515, 555, 619, 562, 572, 589, 751, 788, 737, 790, 620, 787, 775, 639, 540, 325, 812, 546, 780, 817, 559, 823, 768, and 547, wherein the numbering is relative to the amino acid sequence of SEQ ID NO: 31. In some embodiments, the at least one amino acid substitution can optionally occur at any one or more positions selected from the group consisting of 241, 209, 234, 236, 220, 260, 324, 267, 277, 294, 456, 493, 442, 495, 325, 492, 480, 344, 245, 30, 517, 251, 485, 522, 264, 528, 473, and 252, wherein the numbering is relative to the amino acid sequence of SEQ ID NO: 35. In some embodiments, the recombinant polymerase includes at least two, three, four, five, or more amino acid substitutions occurring at positions selected from this group. Without being bound to any particular theory of operation, it can be observed that in some embodiments a recombinant polymerase including any one of such amino acid substitutions exhibits an altered (e.g., increased or decreased) binding affinity for a nucleic acid template relative to an unmodified polymerase, or an altered (e.g., increased or decreased) rate of dissociation from the nucleic acid template ("off-rate") relative to the corresponding unmodified polymerase, or relative to a reference polymerase. In some embodiments, the recombinant polymerase exhibits an altered (e.g., increased or decreased) read length, or an altered (e.g., increased or decreased) average error-free read length, or altered (e.g., increased or decreased) dissociation time constant, or altered (e.g., increased or decreased) observed 100Q17 or 200Q17 values relative to the reference polymerase. In some embodiments, the recombinant polymerase exhibits a change (e.g., increase or decrease) in any one or more properties selected from the group consisting of: DNA binding affinity, off-rate, 100Q17 value and 200Q17 value, relative to the reference polymerase. Optionally, the change is observed by comparing the properties of the reference and recombinant polymerases in an ion-based sequencing reaction.

In some embodiments, the one or more mutations in the recombinant polymerase can include at least one amino acid substitution. The at least one amino acid substitution can optionally occur at any one or more positions selected from the group consisting of: 31, 46, 77, 113, 114, 130, 144, 212, 220, 234, 241, 251, 263, 264, 272, 273, 280, 281, 294, 299, 303, 331, 325, 335, 336, 354, 370, 409, 416, 418, 420, 423, 425, 428, 429, 446, 448, 457, 462, 473, 477, 480, 485, 487, 488, 493, 495, 528, 533, 572, 577 and 579, wherein the numbering is relative to the amino acid sequence of SEQ ID NO: 1. In some embodiments, the recombinant polymerase includes at least two, three, four, five, or more amino acid substitutions occurring at positions selected from this group. In some embodiments, the recombinant polymerase includes the amino acid sequence of SEQ ID NO: 1, or includes the amino acid sequence of a biologically active fragment of a polymerase having the amino acid sequence of SEQ ID NO: 1, or includes the amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of SEQ ID NO: 1, and further includes at least one amino acid substitution at any one or more positions selected from the group consisting of: 46, 273, 281, 446, 473, 477, 528 and 572, as well as at least one amino acid substitution at any one or more positions selected from the group consisting of: 31, 77, 113, 114, 130, 144, 212, 220, 234, 241, 251, 264, 272, 280, 294, 299, 303, 331, 325, 335, 336, 354, 370, 409, 416, 418, 420, 423, 425, 428, 429, 448, 457, 462, 480, 485, 487, 488, 493, 495, 533, 577 and 579, wherein the numbering is relative to the amino acid sequence of SEQ ID NO: 1, In some embodiments, the recombinant polymerase includes at least two, three, four, five, or more amino acid substitutions occurring at positions selected from each of these two groups of amino acid substitutions.

In some embodiments, the recombinant polymerase has an altered (e.g., increased or decreased) binding affinity for a nucleic acid template relative to a reference polymerase. In some embodiments, the recombinant polymerase has an altered (e.g., increased or decreased) rate of dissociation from the nucleic acid template ("off-rate") relative to a reference polymerase. In some embodiments, the recombinant polymerase exhibits an altered (e.g., increased or decreased) read length, or an altered (e.g., increased or decreased) average error-free read length, or an altered (e.g., increased or decreased) observed 100Q17 or 200Q17 value relative to the reference polymerase. In some embodiments, the recombinant polymerase exhibits a change (e.g., increase or decrease) in any one or more of the following properties: binding affinity for a nucleic acid template, dissociation time constant, off-rate, 100Q17 value, and 200Q17 value, relative to the reference polymerase. In some embodiments, the altered property is increased or decreased by at least 10%, 20%, 30%, 40%, 50%, 75%, 90%, 100%, 200%, 300%, 500%, 750%, 1000%, 3000% or greater, relative to the corresponding unmodified polymerase, or to the reference polymerase. Optionally, the change is observed by comparing the properties of the reference and recombinant polymerases in an ion-based sequencing reaction.

SEQ ID NO: 16 comprises the amino acid sequence of a naturally occurring (wild-type) Bst DNA polymerase.

In some embodiments, the reference polymerase is a Bst DNA polymerase having, or comprising the amino acid sequence of SEQ ID NO: 16, and the recombinant polymerase is a mutant or variant of the reference polymerase and further includes one or more amino acid mutations relative to the reference polymerase. In some embodiments, the recombinant polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. Optionally, the one or more amino acid substitutions present in the recombinant polymerase relative to the reference polymerase can include at least one conservative amino acid substitution.

In some embodiments, the modified polymerase consists of or comprises an isolated variant of a Bst DNA polymerase having or comprising the amino acid sequence of SEQ ID NO: 31.

SEQ ID NO: 31 contains three amino acid substitutions as compared to SEQ ID NO: 16, namely: D718K, N782R and H576M, wherein the numbering is relative to the amino acid sequence of SEQ ID NO: 16.

In some embodiments, the reference polymerase, the modified polymerase or both the reference and modified polymerase consists of or comprises an isolated variant of a polymerase having or comprising an amino acid sequence that is at least 90% identical to the amino acid sequence of SEQ ID NO: 31. In some embodiments, the modified polymerase is a variant of a Bst DNA polymerase comprising the amino acid sequence of SEQ ID NO: 31, wherein the variant comprises an amino acid sequence that is at least 80%, at least 85%, at least 90%, at least 91%, at least 92%, at least 93%, at least 94%, at least 95%, at least 96%, at least 97%, at least 98%, or at least 99% identical to SEQ ID NO: 31.

In some embodiments, the reference polymerase is a Bst DNA polymerase having, or comprising, the amino acid sequence of SEQ ID NO: 31 and the modified polymerase further includes one or more amino acid modifications (e.g., amino acid substitutions, deletions, additions or chemical modifications) relative to the reference polymerase. In some embodiments, the reference polymerase, the modified polymerase, or both the reference and modified polymerases include a deletion or substitution of the methionine residue at position 1, wherein the numbering is relative to the amino acid sequence of SEQ ID NO: 31.

In some embodiments, the modified polymerase can include the amino acid sequence of any biologically active fragment of a polymerase having or comprising the amino acid sequence of SEQ ID NO: 31. In some embodiments, the reference polymerase and/or the modified polymerase can include the amino acid sequence of any biologically active fragment of a polymerase having or comprising an amino acid sequence that is at least 90% identical to the amino acid sequence of SEQ ID NO: 31.

SEQ ID NO: 34 contains five amino acid substitutions as compared to SEQ ID NO: 2, namely N487R, H281M, D264A, H273N and E493R, wherein the numbering is relative to the amino acid sequence of SEQ ID NO: 2.

SEQ ID NO: 35 contains three amino acid substitutions as compared to SEQ ID NO: 2, namely N487R, H281M and D423K, wherein the numbering is relative to the amino acid sequence of SEQ ID NO: 2.

In some embodiments, the modified polymerase comprises a recombinant polymerase containing an amino acid sequence that has at least 80% homology to SEQ ID NO: 2 or a biologically active fragment thereof, wherein the recombinant polymerase comprises a Family A DNA polymerase having one or more amino acid substitutions at positions corresponding to positions selected from the group consisting of: N487, N485, E493, A263, D264, H528, H273, D423, D480 and H281, wherein the numbering is relative to SEQ ID NO: 2, and wherein the recombinant polymerase exhibits a decreased dissociation rate constant as compared to SEQ ID NO: 2. In some embodiments, the recombinant polymerase includes one or more amino acid substitutions at positions corresponding to positions selected from the group consisting of: N487R, N485K, E493R, A263K, D264A, D264R, H528S, H528F, H273N, D423K, D480R and H281M, wherein the numbering is relative to SEQ ID NO: 2.

In some embodiments, the reference polymerase, the modified polymerase, or both the reference and modified polymerases can further include a deletion of the methionine residue at position 1, or a substitution of the methionine residue at position 1 with any other amino acid residue, wherein the numbering is relative to the amino acid sequence of SEQ ID NO: 16. Optionally, the reference polymerase, the modified polymerase, or both the reference and modified polymerases can further include one or more amino acid mutations that decrease or eliminate exonuclease activity. Some exemplary mutations that can reduce or eliminate the exonuclease activity of the polymerase are described further herein. In some embodiments, the reference polymerase has or comprises the amino acid sequence of SEQ ID NO: 16, and the modified polymerase has or comprises the amino acid sequence of the reference polymerase and further including at least one amino acid substitution relative to the reference polymerase. In some embodiments, the modified polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. In some embodiments, the modified polymerase further includes any one or more amino acid mutations selected from the group consisting of: N326R, N326K, D372K, D372H, D408N, D409R, D425A, D425H, D439M, D439K, L507A, E515K, N529R, N529K, V536K, V546K, A558K, D559A, D559R, D559Q, D559S, Y567R, H568N, L575R, H576M, E589S, E589F, E589G, V594K, V594H, V594F, D598R, I626Q, L630T, E631P, I649W, I649F, I665A, Q704R, G711K, V713M, V713I, G715K, D718S, D718K, D718N, D718R, D718T, D718G, D718I, D718K, G720R, Q723W, N724R, N724K, F743K, N752T, A757T, D775R, D775F, D775H, D775A, D775S, D775N, D775Q, N780W, N780Y, N780K, N782H, N782W, N782F, N782I, E782Q, V783R, E788R, E788Q, M790Q, H823S, H823F V828I, W872Y and D874F, wherein the numbering is relative of the amino acid sequence of SEQ ID NO: 16. Without being bound to any particular theory of operation, it can be observed that in some embodiments a modified polymerase including one or more of these mutations exhibits an altered (e.g., increased or decreased) rate of dissociation from the nucleic acid template ("off-rate") relative to the unmodified polymerase. In some embodiments, the modified polymerase exhibits an altered, e.g., increased or decreased dissociation time constant relative to the reference polymerase. In some embodiments, the modified polymerase exhibits an altered, e.g., increased or decreased read length, or an altered average error-free read length, or altered (e.g., increased or decreased) observed 100Q17 or 200Q17 values relative to the reference polymerase. In some embodiments, the modified polymerase exhibits a change in any one or more of the following kinetic parameters: average read length, minimum read length, raw accuracy, strand bias, systematic error, total sequencing throughput, enhanced performed in higher ionic strength solution, improved processivity, performance in polymerase chain reaction, performance in emulsion polymerase chain reaction, dissociation time constant, off-rate, AQ20, 100Q17 value, and 200Q17 value, relative to the reference polymerase. Optionally, the change is observed by comparing the performance of the reference and modified polymerases in an ion-based sequencing reaction. In some embodiments, the reference polymerase, the modified polymerase, or both the reference and modified polymerases can further include one or more amino acid mutations that decrease or eliminate exonuclease activity.

In some embodiments, the reference polymerase has or comprises the amino acid sequence of SEQ ID NO: 16, and the modified polymerase has or comprises the amino acid sequence of the reference polymerase and further includes at least one amino acid substitution relative to the reference polymerase. In some embodiments, the modified polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. In some embodiments, the modified polymerase further includes an amino acid substitution at any one or more positions selected from the group consisting of: 326, 341, 372, 388, 408, 409, 425, 439, 507, 515, 529, 533, 536, 546, 547, 558, 559, 567, 568, 575, 576, 589, 594, 598, 626, 630, 631, 649, 665, 704, 711, 713, 715, 718, 720, 723, 724, 741, 743, 752, 757, 768, 772, 775, 780, 782, 783, 788, 790, 823, 828, 845, 867, 872 and 874, wherein the numbering is relative of the amino acid sequence of SEQ ID NO: 16.

In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the modified polymerase, or both the reference and modified polymerases can further include a deletion of the methionine residue at position 1, or a substitution of the methionine residue at position 1 with any other amino acid residue, wherein the numbering is relative to the amino acid sequence of SEQ ID NO: 16. In some embodiments, the modified polymerase exhibits a change in any one or more parameters selected from the group consisting of: average read length, minimum read length, raw accuracy, strand bias, systematic error, total sequencing throughput, enhanced performed in higher ionic strength solution, improved processivity, performance in polymerase chain reaction, performance in emulsion polymerase chain reaction, AQ20, buffering capacity, off-rate, 100Q17 value and 200Q17 value, relative to the reference polymerase. Optionally, the change is observed by comparing the performance of the reference and modified polymerases in an ion-based sequencing reaction. Optionally, the reference polymerase, the modified polymerase, or both the reference and modified polymerases can further include one or more amino acid mutations that decrease or eliminate exonuclease activity.

In some embodiments, the reference polymerase has or comprises the amino acid sequence of SEQ ID NO: 16, and the modified polymerase has or comprises the amino acid sequence of the reference polymerase and further includes at least one amino acid substitution relative to the reference polymerase. In some embodiments, the modified polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase. The at least one amino acid substitution can optionally occur at any one or more positions selected from the group consisting of: 341, 388, 533, 547, 568, 576, 741, 768, 772, 823, 845 and 867. In some embodiments, the modified polymerase can further include at least one amino acid substitution at one or more positions selected from the group consisting of: 326, 372, 408, 409, 425, 439, 507, 515, 529, 536, 546, 559, 567, 575, 589, 594, 598, 626, 630, 631, 649, 665, 704, 711, 713, 715, 718, 720, 723, 724, 743, 752, 757, 775, 780, 782, 783, 788, 790, 828, 872 and 874, wherein the numbering is relative of the amino acid sequence of SEQ ID NO: 16. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the modified polymerase, or both the reference and modified polymerases can further include a deletion of the methionine residue at position 1, or a substitution of the methionine residue at position 1 with any other amino acid residue, wherein the numbering is relative to the amino acid sequence of SEQ ID NO: 16. In some embodiments, the modified polymerase exhibits a change in any one or more parameters selected from the group consisting of: buffering capacity, average read length, minimum read length, raw accuracy, strand bias, systematic error, total sequencing throughput, enhanced performed in higher ionic strength solution, improved processivity, performance in polymerase chain reaction, performance in emulsion polymerase chain reaction, dissociation time constant, off-rate, AQ20, 100Q17 value and 200Q17 value, relative to the reference polymerase. Optionally, the change is observed by comparing the performance of the reference and modified polymerases in an ion-based sequencing reaction. Optionally, the reference polymerase, the modified polymerase, or both the reference and modified polymerases can further include one or more amino acid mutations that decrease or eliminate exonuclease activity.

In some embodiments, the recombinant polymerase includes at least 80% identity to SEQ ID NO: 31 or a fragment thereof, exhibits polymerase activity, and further includes one or more amino acid substitutions selected from the group consisting of E325K, G504Q, N529K or N529R, P531I or P531R, V536K, V546R, L547R, E515H or E515K or E515T, E540R, S555K, D559K or D559M, E562M or E562K or E562R, E572T, E589K, T619R, E620R, A639Y, E751R, E737R, E737Y, H768G, M790C, A787K, D775L, D775R, N780R, E788G or E788R, N812C or N812K, E817C, and H823T wherein the numbering is relative to SEQ ID NO: 31.

In some embodiments, the amino acid substitutions include the substitution of the existing amino acid residue at the indicated position with any other amino acid residue (including both naturally occurring and non-natural amino acid residues). In some embodiments, the amino acid substitution includes a conservative substitution; alternatively, the amino acid substitution can include a non-conservative substitution. In some embodiments, the reference polymerase, the recombinant polymerase, or both the reference and recombinant polymerase can further include a deletion of the methionine residue at position 1, or a substitution of the methionine residue at position 1 with any other amino acid residue, wherein the numbering is relative to the amino acid sequence of SEQ ID NO: 31. In some embodiments, the recombinant polymerase exhibits an improvement in any one or more sequencing parameters selected from the group consisting of average read length, accuracy, strand bias, systematic error, total sequencing throughput, and improved processivity, as compared to the reference polymerase.

Optionally, the improvement in the one or more sequencing parameters is observed by comparing the performance of the reference and recombinant polymerase in an ion-based sequencing reaction. Optionally, the reference polymerase, the recombinant polymerase, or both the reference and recombinant polymerase can further include one or more amino acid substitutions that reduce or eliminate exonuclease activity.

In some embodiments, the recombinant polymerase includes at least 80% identity to SEQ ID NO: 35 or a fragment thereof, exhibits polymerase activity, and further includes one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T, wherein the numbering is relative to SEQ ID NO: 35.

In some embodiments, the recombinant polymerase includes at least 80% identity to SEQ ID NO: 35 or a fragment thereof, exhibits polymerase activity, and further includes two or more amino acid substitutions selected from the group consisting of E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 35.

In some embodiments, the amino acid substitutions include the substitution of the existing amino acid residue at the indicated position with any other amino acid residue (including both naturally occurring and non-natural amino acid residues). In some embodiments, the amino acid substitution includes a conservative substitution; alternatively, the amino acid substitution can include a non-conservative substitution. In some embodiments, the reference polymerase, the recombinant polymerase, or both the reference and recombinant polymerase can further include a deletion of the methionine residue at position 1, or a substitution of the methionine residue at position 1 with any other amino acid residue, wherein the numbering is relative to the amino acid sequence of SEQ ID NO: 35. In some embodiments, the recombinant polymerase exhibits an improvement in any one or more sequencing parameters selected from the group consisting of average read length, accuracy, strand bias, systematic error, total sequencing throughput, and improved processivity, as compared to the reference polymerase. Optionally, the improvement in the one or more sequencing parameters is observed by comparing the performance of the reference and recombinant polymerase in an ion-based sequencing reaction. Optionally, the reference polymerase, the recombinant polymerase, or both the reference and recombinant polymerase can further include one or more amino acid substitutions that reduce or eliminate exonuclease activity.

In some embodiments, the modified polymerase comprises an amino acid sequence that is at least 80%, at least 85%, at least 90%, at least 91%, at least 92%, at least 93%, at least 94%, at least 95%, at least 96%, at least 97%, at least 98%, or at least 99% identical to the amino acid sequence of the reference polymerase.

In some embodiments, the modified polymerase has polymerase activity. The modified polymerase or biologically active fragment can have primer extension activity in vivo or in vitro.

In some embodiments, the one or more mutations in the modified polymerase can include at least one amino acid substitution. The at least one amino acid substitution can optionally occur at any one or more positions selected from the group consisting of: 341, 388, 533, 547, 568, 576, 741, 768, 772, 823, 845 and 867, wherein the numbering is relative to the amino acid sequence of SEQ ID NO: 16. In some embodiments, the modified polymerase includes at least two, three, four, five, or more amino acid substitutions occurring at positions selected from this group. Without intending to be bound to any particular theory of action, it can be observed that in some embodiments, amino acid substitution at such positions can alter, e.g., increase or decrease the buffering capacity of the modified polymerase relative to the corresponding unmodified polymerase, or relative to a reference polymerase. Such mutations can therefore be referred to as "buffering" mutations. In some embodiments, such increase or decrease in buffering capacity can increase the observed signal in an ion-based sequencing reaction.

In some embodiments, the one or more mutations in the modified polymerase can include at least one amino acid substitution. The at least one amino acid substitution can optionally occur at any one or more positions selected from the group consisting of: 326, 372, 408, 409, 425, 439, 507, 515, 529, 536, 546, 559, 567, 575, 589, 594, 598, 626, 630, 631, 649, 665, 704, 711, 713, 715, 718, 720, 723, 724, 743, 752, 757, 775, 780, 782, 783, 788, 790, 828, 872 and 874, wherein the numbering is relative to the amino acid sequence of SEQ ID NO: 16. In some embodiments, the modified polymerase includes at least two, three, four, five, or more amino acid substitutions occurring at positions selected from this group. Without being bound to any particular theory of operation, it can be observed that in some embodiments a modified polymerase including any one of such amino acid substitutions exhibits an altered (e.g., increased or decreased) binding affinity for a nucleic acid template relative to an unmodified polymerase, or an altered (e.g., increased or decreased) rate of dissociation from the nucleic acid template ("off-rate") relative to the corresponding unmodified polymerase, or relative to a reference polymerase. In some embodiments, the modified polymerase exhibits an altered (e.g., increased or decreased) read length, or an altered (e.g., increased or decreased) average error-free read length, or altered (e.g., increased or decreased) dissociation time constant, or altered (e.g., increased or decreased) observed 100Q17 or 200Q17 values relative to the reference polymerase. In some embodiments, the modified polymerase exhibits a change (e.g., increase or decrease) in any one or more properties selected from the group consisting of: DNA binding affinity, raw accuracy, strand bias, systematic error, total sequencing throughput, off-rate, 100Q17 value and 200Q17 value, relative to the reference polymerase. Optionally, the change is observed by comparing the properties of the reference and modified polymerases in an ion-based sequencing reaction.

In some embodiments, the one or more mutations in the modified polymerase can include at least one amino acid substitution. The at least one amino acid substitution can optionally occur at any one or more positions selected from the group consisting of: 326, 341, 372, 408, 409, 425, 439, 507, 515, 529, 536, 546, 547, 559, 567, 568, 575, 576, 589, 594, 598, 626, 630, 631, 649, 665, 704, 711, 713, 715, 718, 720, 723, 724, 741, 743, 752, 757, 768, 772, 775, 780, 782, 783, 788, 790, 823, 828, 867, 872 and 874, wherein the numbering is relative to the amino acid sequence of SEQ ID NO: 16. In some embodiments, the modified polymerase includes at least two, three, four, five, or more amino acid substitutions occurring at positions selected from this group.

In some embodiments, the modified polymerase includes the amino acid sequence of SEQ ID NO: 16, or the amino acid sequence of a biologically active fragment of a polymerase having the amino acid sequence of SEQ ID NO: 16 and further includes at least one amino acid substitution at any one or more positions selected from the group consisting of: 341, 568, 576, 741, 768, 772, 823, 845 and 867, as well as at least one amino acid substitution at any one or more positions selected from the group consisting of: 326, 372, 408, 409, 425, 439, 507, 515, 529, 536, 546, 559, 567, 575, 589, 594, 598, 626, 630, 631, 649, 665, 704, 711, 713, 715, 718, 720, 723, 724, 743, 752, 757, 775, 780, 782, 783, 788, 790, 828, 872 and 874, wherein the numbering is relative to the amino acid sequence of SEQ ID NO: 16, In some embodiments, the modified polymerase includes at least two, three, four, five, or more amino acid substitutions occurring at positions selected from each of these two groups of amino acid substitutions.

In some embodiments, the modified polymerase further includes at least one amino acid substitution selected from the group consisting of: H341A, H341R, L547R, H568A, H568R, H576A, H576R, H576M, E741Q, H768A, H768R, Y772F, H823A, H823R, H823K, H867A and H867R, wherein the numbering is relative of the amino acid sequence of SEQ ID NO: 16. In some embodiments, the modified polymerase includes any two, three, four, five or more of these amino acid substitutions.

In some embodiments a modified polymerase including one or more of these mutations exhibits an altered (e.g., increased or decreased) binding affinity for a nucleic acid template relative to the corresponding unmodified polymerase or to a reference polymerase. In some embodiments, the modified polymerase has an altered (e.g., increased or decreased) rate of dissociation from the nucleic acid template ("off-rate") relative to the unmodified polymerase or to a reference polymerase. In some embodiments, the modified polymerase exhibits an altered, e.g., increased or decreased read length, or increased raw accuracy, or decreased strand bias, or lowered systematic error, or increased total sequencing throughput, or an altered average error-free read length, or altered (e.g., increased or decreased) observed 100Q17 or 200Q17 values relative to the reference polymerase. In some embodiments, the modified polymerase exhibits a change in any one or more of the following kinetic parameters: average read length, minimum read length, raw accuracy, strand bias, systematic error, total sequencing throughput, enhanced performed in higher ionic strength solution, improved processivity, performance in polymerase chain reaction, performance in emulsion polymerase chain reaction, dissociation time constant, off-rate, AQ20, 100Q17 value, and 200Q17 value, relative to the reference polymerase. Optionally, the change is observed by comparing the performance of the reference and modified polymerases in an ion-based sequencing reaction. In some embodiments, the amino acid substitutions include the substitution of the existing amino acid residue at the indicated position with any other amino acid residue (including both naturally occurring and non-natural amino acid residues). In some embodiments, the amino acid substitution is a conservative substitution; alternatively, the amino acid substitution can be a non-conservative substitution. In some embodiments, the reference polymerase, the modified polymerase, or both the reference and modified polymerases can further include a deletion of the methionine residue at position 1, or a substitution of the methionine residue at position 1 with any other amino acid residue, wherein the numbering is relative to the amino acid sequence of SEQ ID NO: 16. In some embodiments, the modified polymerase exhibits a change in any one or more parameters selected from the group consisting of: buffering capacity, average read length, minimum read length, enhanced performed in higher ionic strength solution, improved processivity, performance in polymerase chain reaction, performance in emulsion polymerase chain reaction, off-rate, AQ20, 100Q17 value and 200Q17 value, relative to the reference polymerase. Optionally, the change is observed by comparing the performance of the reference and modified polymerases in an ion-based sequencing reaction. Optionally, the reference polymerase, the modified polymerase, or both the reference and modified polymerases can further include one or more amino acid mutations that decrease or eliminate exonuclease activity.

In some embodiments, the modified polymerase has an altered (e.g., increased or decreased) binding affinity for a nucleic acid template relative to a reference polymerase. In some embodiments, the modified polymerase has an altered (e.g., increased or decreased) rate of dissociation from the nucleic acid template ("off-rate") relative to a reference polymerase. In some embodiments, the modified polymerase exhibits an altered (e.g., increased or decreased) read length, or an altered (e.g., increased or decreased) average error-free read length, or an altered (e.g., increased or decreased) observed 100Q17 or 200Q17 value relative to the reference polymerase. In some embodiments, the modified polymerase exhibits a change (e.g., increase or decrease) in any one or more of the following properties: binding affinity for a nucleic acid template, dissociation time constant, off-rate, 100Q17 value, and 200Q17 value, relative to the reference polymerase. In some embodiments, the altered property is increased or decreased by at least 10%, 20%, 30%, 40%, 50%, 75%, 90%, 100%, 200%, 300%, 500%, 750%, 1000%, 3000% or greater, relative to the corresponding reference polymerase. Optionally, the change is observed by comparing the properties of the reference and modified polymerases in an ion-based sequencing reaction.

Optionally, the reference polymerase, the modified polymerase, or both the reference and modified polymerases can further include one or more amino acid mutations that decrease or eliminate any exonuclease activity of the polymerase. In some embodiments, the reference polymerase, the modified polymerase, or both the reference and modified polymerase is a Bst DNA polymerase that has proofreading exonuclease activity. In various embodiments, the proofreading exonuclease activity of a modified Bst DNA polymerase is at least about 40%, 50%, 60%, 70%, 80% or 90% that of the corresponding wild type protein. In order to retain the proofreading exonuclease activity of a modified Bst DNA polymerase, the skilled artisan will understand that any substitutions, deletions or chemical modifications should be made to amino acid residues that are not highly conserved within the Exo I, Exo II and Exo III motifs.

As the skilled artisan will readily appreciate, the scope of the present disclosure encompasses not only the specific amino acid and/or nucleotide sequences disclosed herein, but also, for example, many related sequences encoding genes and/or peptides with the functional properties described herein. For example, the scope and spirit of the disclosure encompasses any nucleotide and amino acid sequences encoding conservative variants of the various polymerases disclosed herein. It will also be readily apparent to the skilled artisan that the modified polymerases disclosed herein by amino acid sequence can be converted to the corresponding nucleotide sequence without undue experimentation, for example using a number of freely available sequence conversion applications (e.g. "in-silco").

TABLE 1

| SEQ ID NO: 16 | SEQ ID NO: 1 | SEQ ID NO: 18 | SEQ ID NO:15 |
|---|---|---|---|
| E515K | E220K | E245 | E471 |
| N529R | N234R | S259R | N485R |
| V536K | V241K | T266K | R492K |
| D559K | D264K | E290K | D513K |
| D718K | D423K | A448K | A675K |
| D775R | D480R | D505R | D732R |
| N782R | N487R | A512W | S739W |
| V783R | V488R | | V740R |
| E788Q | E493Q | E518 | E745 |

While not wishing to be bound by any particular theory, it was observed that nine different amino acid mutations per polymerase (of Table 1) were transferable (homologous) among the four polymerases (full length Bst polymerase (SEQ ID NO: 16), large fragment (581 amino acid) Bst polymerase (SEQ ID NO: 1), Taq DNA polymerase (SEQ ID NO: 15) and Klenow Fragment of *E. Coli* Pol I (SEQ ID NO: 18)). As a result, it is reasonably believed that once an amino acid mutation is identified in a polymerase that provides altered catalytic properties, the amino acid mutation can be screened using methods known to one of ordinary skill in the art (such as amino acid or nucleotide sequence alignment), to determine if the amino acid mutation can be transferred to a different polymerase, such as a different species, class or polymerase family (as demonstrated herein). In some embodiments, the transferable (or homologous) amino acid mutation can include an amino acid mutation that enhances catalytic properties such as increased read-length, increased raw accuracy, decreased strand bias, lowered systematic error, improved homopolymer accuracy, increased total sequencing throughput, increased error-free read length, enhanced processivity, increased 100Q17 value, increased 200Q17 value, and the like. In some embodiments, the transferable (or homologous) amino acid mutation can include an amino acid mutation that decrease catalytic properties such as decreased read-length, decreased error-free read length, decreased processivity, decreased 100Q17 value, decreased 200Q17 value, and the like. In some embodiments, a transferable (or homologous) amino acid mutation can include transferring one or more amino acid mutations to another polymerase within, or between, DNA polymerase families, such as DNA polymerase family A, DNA polymerase family B, or DNA polymerase family C. It will be readily apparent to the skilled artisan that a transferable (i.e., homologous) amino acid mutation, such as an amino acid substitution present in a first polymerase may be transferred to a corresponding amino acid position in a homologous polymerase. For example, sequence alignment of the first polymerase having the first amino acid substitution against a B family DNA polymerase, A family DNA polymerase, or C family DNA polymerase can result in the identification of the corresponding amino acid residue in the homologous A family, B family or C family DNA polymerase. Examples of B family DNA polymerase alignment are well known in the art and include for example Hopfner et al., Proc. Natl. Acad. Sci. USA (1999), 96: 3600-3605 and Kahler and Antranikian, Bacteriol., (2000), 182: 655-663, which are incorporated herein by reference in their entireties. Examples of A and C family DNA polymerase alignments are also well known in the art and include for example Ito and Braithwaite, Nucleic Acids Research, (1991), Vol. 19, 15: 4045-4057, and Braithwaite and Ito, Nucleic Acids Research, (1993), Vol. 21, 4: 787-802, are incorporated herein by reference in their entireties. In some embodiments, a transferable (or homologous) amino acid mutation can include transferring one or more amino acid mutations to one or more polymerases within, or between, DNA polymerase families, such as across bacterial, viral, archaeal, eukaryotic or phage DNA polymerases.

Certain embodiments of the current invention include mutant A, B, or C family DNA polymerases other than Bst DNA polymerase, that include amino acid mutations corresponding to either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T of Bst DNA polymerase; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T of Bst DNA polymerase. The mutant (e.g. recombinant) DNA polymerase can yield a lower average systematic error rate or improved accuracy when used in a sequencing by synthesis reaction as compared to the average systematic error rate or accuracy achieved using a corresponding wild-type polymerase. The mutant (e.g. recombinant) polymerase in illustrative embodiments, includes amino acid substitutions in the A, B, or C family polymerase that are equivalent to H46R, E446Q, and H572R, and/or mutations H281M, D423K, and N487R, of Bst DNA polymerase. In illustrative embodiments, the mutant polymerases include A, B, or C family polymerases that include amino acid mutations corresponding to any one of, or all of the 9 amino acid mutations in SEQ ID NO: 119 disclosed herein for Bst DNA polymerase. Example 3 demonstrates that a mutant Klenow mutations can be generated with a corresponding mutation (D505R), to a mutant (D775R) of Bst DNA polymerase 581 amino acid fragment, and provides similar improved activity to the mutant Bst DNA polymerase. In illustrative embodiments, provided herein is a Klenow fragment por a Taq polymerase that includes the corresponding mutation to the 581 mutant Bst polymerase fragment having L252R, wherein the numbering is relative to SEQ ID NO: 1. For example, such Klenow fragment has L276R or such Taq polymerase has I503R. Accordingly, provided herein is an isolated mutant (e.g. recombinant) Klenow polymerase having 85%, 90%, 95%, 96%, 97%, 98%, 99% identical to SEQ ID NO: 18 having L276R, or identical to SEQ ID NO: 18 except for L276R. The Klenow or Taq mutant is expected to yield reduced error when used in an ion-based sequencing by synthesis reaction, such as a reaction where hydrogen ions are released or detected. In illustrative examples, provided herein is an isolated mutant Taq polymerase that is 85%, 90%, 95%, 96%, 97%, 98%, 99% identical to SEQ ID NO: 15 having I503R, or identical to SEQ ID NO: 15 except for I503R.

Certain aspects of the invention include nucleic acid or polynucleotides encoding any of the mutant Bst DNA polymerases provided herein. Such nucleic acids can be included in vectors, such as expression vectors that include any additional vector elements known in the art for such type of vectors. For example, such vectors can include an origin of replication, a promoter, such as, for example, an inducible promoter, a poly A signal and can encode a tag, such as a detectable tag or a purification tag. As such, embodiments herein include mutant polypeptides provided herein, as fusion proteins, fused to a detectable tag and/or a purification tag. SEQ ID NO: 17 includes a nucleic acid sequence that encodes an exemplary modified polymerase that has the amino acid sequence of SEQ ID NO: 2 and further includes the mutation D775R. It be readily apparent to the skilled artisan how to modify the nucleic acid sequence of SEQ ID NO: 17 to generate nucleic acid sequences encoding any of the other exemplary reference or modified polymerases disclosed herein. As such, provided herein are recombinant nucleic acid molecules (i.e. polynucleotides), and recombinant expression vectors including the same, that encode a mutant Bst DNA polymerase, that include a polypeptide segment that is 75%, 80%, 85%, 90%, 95%, 96%, 97%, 98%, 99%, or 100% identical to SEQ ID NO: 1 or SEQ NO: 16, having amino acid mutations corresponding to either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T of Bst DNA polymerase; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T of Bst DNA polymerase. The encoded mutant (e.g. recombinant) DNA polymerase can yield a lower average systematic error rate or improved accuracy when used in a sequencing by synthesis reaction as compared to the average systematic error rate or accuracy achieved using a corresponding wild-type polymerase, or any of the improved properties for these polymerases provided in the Examples herein. The encoded recombinant mutant polymerase in illustrative nucleic acid and vector embodiments, includes amino acid substitutions H46R, E446Q, and H572R, and/or mutations H281M, D423K, and N487R, of Bst DNA polymerase. The encoded mutant (e.g. recombinant) DNA polymerase in illustrative nucleic acid and vector examples, includes one or more of L252R, H473G, and H528T, wherein the numbering is relative to SEQ ID NO: 1). Accordingly, in certain examples provided herein, are nucleic acids (i.e. polynucleotides), and vectors including the nucleic acids, that encode a mutant (e.g. recombinant) DNA polymerase having at least 80%, 85%, 90%, 95%, 96%, 97%, 98%, or 99% identity to SEQ ID NO: 1 or SEQ ID NO: 16, or a fragment thereof, exhibits polymerase activity, includes amino acid substitutions H46R, E446Q, H572R, H281M, D423K, and N487R, and further includes any one of L252R, H473G. or H528T, or all of L252R, H473G, and H528T, wherein the numbering is relative to SEQ ID NO: 1. In an exemplary embodiment having such mutations, the nucleic acid and vector including the same, encodes the mutant Bst DNA polymerase that has the sequence of SEQ ID NO: 119 or SEQ ID NO: 121.

In some embodiments, the nucleotide sequence can be designed employing principles of codon preference to increase the levels of protein expression in a given host organism.

In some embodiments, in order to slow the rate of template dissociation from the polymerase (and increase its processivity), the modified polymerase or any biologically active fragment of a polymerase can include one or more amino acid mutations that cause the modified to dissociate more slowly from the nucleic acid template. Such mutations can have the additional effect of increasing the read length (or the error-free read length) of the modified polymerase relative to its unmodified counterpart.

In some embodiments, the modified polymerase or any biologically active fragment of a polymerase can include one or more biotin moieties. As used herein, the terms "biotin" and "biotin moiety" and their variants comprise biotin (cis-hexahydro-2-oxo-1H-thieno[3,4]imidazole-4-pentanoic acid) and any derivatives and analogs thereof, including biotin-like compounds. Such compounds include, for example, biotin-ε-N-lysine, biocytin hydrazide, amino or sulfhydryl derivatives of 2-iminobiotin and biotinyl-ε-aminocaproic acid-N-hydroxysuccinimide ester, sulfosuccinimi-deiminobiotin, biotinbromoacetylhydrazide, p-diazobenzoyl biocytin, 3-(N-maleimidopropionyl) biocytin, and the like, as well as any biotin variants that can specifically bind to an avidin moiety. The terms "avidin" and "avidin moiety" and their variants, as used herein, comprise the native egg-white glycoprotein avidin, as well as any derivatives, analogs and other non-native forms of avidin, which can specifically bind to biotin moieties. In some embodiments, the avidin moiety can comprise deglycosylated forms of avidin, bacterial streptavidins produced by selected strains of *Streptomyces*, e.g., *Streptomyces avidinii*, to truncated streptavidins, and to recombinant avidin and streptavidin as well as to derivatives of native, deglycosylated and recombinant avidin and of native, recombinant and truncated streptavidin, for example, N-acyl avidins, e.g., N-acetyl, N-phthalyl and N-succinyl avidin, and the commercial products ExtrAvidin®, Captavidin®, Neutravidin® and Neutralite Avidin®. All forms of avidin-type molecules, including both native and recombinant avidin and streptavidin as well as derivatized molecules, e.g. nonglycosylated avidins, N-acyl avidins and truncated streptavidins, are encompassed within the terms "avidin" and "avidin moiety". Typically, but not necessarily, avidin exists as a tetrameric protein, wherein each of the four tetramers is capable of binding at least one biotin moiety. As used herein, the term "biotin-avidin bond" and its variants refers to a specific linkage formed between a biotin moiety and an avidin moiety. Typically, a biotin moiety can bind with high affinity to an avidin moiety, with a dissociation constant Kd typically in the order of 10-14 to 10-15 mol/L. Typically, such binding occurs via non-covalent interactions.

In some embodiments, the modified polymerase or any biologically active fragment of a polymerase can include one or more modified or substituted amino acids relative to a reference polymerase, and can further include a biotin moiety that is linked to at least one of the one or more modified or substituted amino acids. The biotin moiety can be linked to the modified polymerase using any suitable linking method. In some embodiments, the modified polymerase includes one or more cysteine replacement substitutions, and the linking moiety includes a biotin moiety that is linked to at least one of the one or more cysteine replacement substitutions.

In some embodiments, the modified polymerase is a biotinylated polymerase. The term "biotinylated" and its variants, as used herein, refer to any covalent or non-covalent adduct of biotin with other moieties such as biomolecules, e.g., proteins, nucleic acids (including DNA, RNA, DNA/RNA chimeric molecules, nucleic acid analogs and peptide nucleic acids), proteins (including enzymes, peptides and antibodies), carbohydrates, lipids, etc.

In some embodiments, the disclosure also relates generally to compositions (as well as related methods, kits and apparatuses) comprising a recombinant polymerase including at least one amino acid mutation relative to a reference polymerase, wherein the recombinant polymerase has a slower rate of dissociation from a nucleic acid template relative to the reference polymerase. In some embodiments, the rate of dissociation can be modified such that the rate of dissociation increases binding affinity, for example in the presence of neutral osmolytes such as betaine, trimethylamine N-oxide, trehalose, sucrose, ethylene glycols, and the like.

As used herein, the terms "dissociation rate" or "off-rate" refer to the rate of dissociation of a given polymerase from a given template nucleic acid. The dissociation rate (off-rate) can vary with reaction conditions including temperature, salt concentrations, relative concentrations of polymerase and template, and the like. In some embodiments, the dissociation rate can be estimated by measuring the decay in total amount of polymerase bound to a template nucleic acid under given reaction conditions. Such assays can optionally be performed using conditions where re-binding of the polymerase to the template after dissociation of the polymerase from the template is prevented. For example, in a typical dissociation binding experiment to measure the "off rate" for polymerase dissociating from the nucleic acid template, the polymerase and nucleic acid template are initially allowed to bind, optionally to equilibrium. Optionally, the polymerase can be labeled using any suitable label (e.g., radioactive or fluorescent labels). At this point, further binding of the polymerase to template can optionally be blocked to simplify measurement of the rate of dissociation from the template. Such blocking can be performed using any suitable method. For example, in embodiments where the template is fixed to a surface and the polymerase is labeled, blocking can be achieved by (1) removing the buffer including labeled polymerase and replacing with buffer that does not include labeled polymerase, or (2) adding to the reaction mixture a very high concentration of unlabeled polymerase; or (3) diluting the reaction mixture by a large factor (e.g., at least 20- or 100-fold), particularly when the initial concentration of labeled polymerase is low. Following such blocking, the total amount of polymerase bound to template can be measured at various times after such blocking to determine how rapidly the polymerase dissociates from the template. The amount of polymerase bound to template can be mapped (Y axis) against time (X axis). In some embodiments, the resulting curve approximates a single exponential decay curve In some embodiments, analysis of binding experiments can be based on a simple model derived from the law of mass action. This model assumes that binding is reversible and allows calculation of koff, the dissociation rate constant. (In the following analysis, the polymerase and nucleic acid template are referred to as "ligand" and "receptor"):

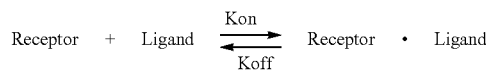

In some embodiments, binding occurs when the polymerase and template nucleic acid collide due to diffusion, and when the collision has the correct orientation and enough energy. The rate of association is:

Number of binding events per unit of time=[Ligand]·[Receptor]·kon.

Once binding has occurred, the ligand and receptor can remain bound together for a random amount of time. The probability of dissociation is the same at every instant of time.

The rate of dissociation is:

Number of dissociation events per unit time= [ligand·receptor]·koff.

Equilibrium is reached when the rate at which new ligand·receptor complexes are formed equals the rate at which the ligand·receptor complexes dissociate. At equilibrium:

$$[\text{Ligand}]\cdot[\text{Receptor}]\cdot k_{on}=[\text{Ligand}\cdot\text{Receptor}]\cdot k_{off}$$

This equation can be rearranged to define the equilibrium dissociation constant Kd.

$$\frac{[\text{Ligand}]\cdot[\text{Receptor}]}{[\text{Ligand}\cdot\text{Receptor}]} = \frac{k_{off}}{k_{on}} = K_d$$

If [Ligand] is set as equal to Kd in the equation above, the Kd terms cancel out, and

[Receptor]/[Ligand·Receptor]=1, so [Receptor] equals [Ligand·Receptor]. Since all the receptors are either free or bound to ligand, this means that half the receptors are free and half are bound to ligand. In other words, when the concentration of ligand equals the Kd, half the receptors will be occupied at equilibrium. If the receptors have a high affinity for the ligand, the Kd will be low, as it will take a low concentration of ligand to bind half the receptors.

In such a model, Kd, the equilibrium dissociation constant, is different from koff, the dissociation rate constant (also referred to herein as the "dissociation time constant").

In one exemplary assay, as described in the Examples herein, the dissociation time constant of a given polymerase can be measured by incubating the polymerase with a labeled oligonucleotide including a fluorescent label (referred to herein as "oligonucleotide 221") under defined conditions. When the oligonucleotide is not bound by polymerase, the fluorescence of the fluorescent label on the oligonucleotide is quenched; binding of the polymerase to the oligonucleotide results in de-quenching of the oligonucleotide label and a resulting increase in fluorescence. Blocking is initiated by adding an unlabeled competitor oligonucleotide to the reaction mixture; as polymerase dissociates from the fluorescently labeled oligonucleotide 221, the competitor oligonucleotide hybridizes to oligonucleotide 221 and prevents further binding of the polymerase. Fluorescence is monitored over time. Fluorescence of the reaction mixture is measured at various time points following addition of the competitor oligonucleotide. The observed fluorescence (in RFU or relative fluorescence units) is graphed (Y axis) against time (X axis). To compare the dissociation rates of two or more different enzymes (e.g., a reference and a modified polymerase), each enzyme can be employed in a parallel and separate reaction in which the fluorescence of each reaction mixture is measured at various time points, following which the dissociation rates for each enzyme can be calculated using any suitable method, and compared. In the Examples provided herein, the dissociation rates are calculated according to the following formula:

$$Y=(Y0-\text{Plateau})*\exp^{(-k*x)}+\text{Plateau}$$

Where:

Y0 is the Y value when X (time) is zero. It is expressed in the same units as Y, Plateau is the Y value at infinite times, expressed in the same units as Y.

K is the rate constant, expressed in reciprocal of the X axis time units. If X is in minutes, then K is expressed in inverse minutes.

Tau is the time constant, expressed in the same units as the X axis. It is computed as the reciprocal of K.

Half-life is in the time units of the X axis. It is computed as ln(2)/K.

Span, i.e., (Y0–Plateau), is the difference between Y0 and Plateau, expressed in the same units as your Y values.

FIG. 1 depicts the results of an exemplary assay performed as described in the Examples, where the dissociation time constants for various exemplary Bst mutants are measured at varying salt concentrations and compared.

In some embodiments, the disclosure relates generally to a method for incorporating at least one nucleotide into a primer, comprising contacting a nucleic acid complex including a template nucleic acid with primer and a mutant (e.g. recombinant) polymerase provided herein, in the presence of one or more nucleotides, and incorporating at least one of the one or more nucleotides into the primer in a template-dependent fashion using said modified polymerase.

Methods for nucleotide incorporation are well known in the art and typically comprise use of a polymerase reaction mixture in which the polymerase is contacted with the template nucleic acid under nucleotide incorporation conditions. When the nucleotide incorporation reaction comprises polymerization of nucleotides onto the end of a primer, the process is typically referred to as "primer extension." Typically but not necessarily such nucleotide incorporation occurs in a template-dependent fashion. Primer extension and other nucleotide incorporation assays are typically performed by contacting the template nucleic acid with a polymerase in the presence of nucleotides in an aqueous solution under nucleotide incorporation conditions. In some embodiments, the nucleotide incorporation reaction can include a primer, which can optionally be hybridized to the template to form a primer-template duplex. Typical nucleotide incorporation conditions are achieved once the template, polymerase, nucleotides and optionally primer are mixed with each other in a suitable aqueous formulation, thereby forming a nucleotide incorporation reaction mixture (or primer extension mixture). The aqueous formulation can optionally include divalent cations and/or salts, particularly $Mg^{++}$ and/or $Ca^{++}$ ions. The aqueous formulation can optionally include divalent anions and/or salts, particularly $SO_4^{2-}$. Typical nucleotide incorporation conditions have included well known parameters for time, temperature, pH, reagents, buffers, reagents, salts, co-factors, nucleotides, target DNA, primer DNA, enzymes such as nucleic acid-dependent polymerase, amounts and/or ratios of the components in the reactions, and the like. The reagents or buffers can include a source of monovalent ions, such as KCl, K-acetate, $NH_4$-acetate, K-glutamate, $NH_4Cl$, or ammonium sulfate. The reagents or buffers can include a source of divalent ions, such as $Mg^{2+}$ and/or $Mn^{2+}$, $MgCl_2$, or Mg-acetate. In some embodiments, the reagents or buffers can include a source of detergent such as Triton and/or Tween. Most polymerases exhibit some levels of nucleotide incorporation activity over pH range of about 5.0 to about 9.5, more typically between about pH 7 and about pH 9, sometimes between about pH 6 to about pH 8, and sometimes between 7 and 8. The buffer can include chelating agents such as EDTA and EGTA, and the like. Although in some embodiments, nucleotide incorporation reactions may include buffering agents, such as Tris, Tricine, HEPES, MOPS, ACES, or MES, which can provide a pH range of about 5.0 to about 9.5, such buffering agents can optionally be reduced or eliminated when performing ion-based reactions requiring detection of ion byproducts. Methods of performing nucleic acid synthesis are well known and extensively practiced in the art and references teaching a wide range of nucleic acid synthesis techniques are readily available. Some exemplary teachings regarding the performance of nucleic acid synthesis (including, for example, template-dependent nucleotide incorporation, as well as primer extension methods) can be found, for example, in Kim et al., Nature 376: 612-616 (2002); Ichida et al., Nucleic Acids Res. 33: 5214-5222 (2005); Pandey et al., European Journal of Biochemistry, 214:59-65 (1993); Blanco et al., J. Biol. Chem. 268: 16763-16770 (1993); U.S. patent application Ser. No. 12/002,781, now published as U.S. Patent Publication No. 2009/0026082; U.S. patent application Ser. No. 12/474,897, now published as U.S. Patent Publication No. 2010/0137143; and U.S. patent application Ser. No. 12/492,844, now published as U.S. Patent Publication No. 2010/0282617; US patent application Ser. No. 12/748,359, now published as U.S. Patent Publication No. 20110014612. Given the ample teaching of primer extension and other nucleotide incorporation reactions in the art, suitable reaction conditions for using the recombinant polymerases of the disclosure to perform nucleotide incorporation will be readily apparent to the skilled artisan.

In some embodiments, the disclosure relates generally to compositions (e.g. reagents) and kits useful for performance of nucleotide polymerization reactions, nucleic acid amplification reactions, and/or nucleic acid sequencing reactions, using mutant (e.g. recombinant) polymerases, that include any of the exemplary recombinant mutant polymerases disclosed herein. The nucleotide polymerization reactions can include without limitation nucleotide incorporation reactions (including both template-dependent and template-independent nucleotide incorporation reactions) as well as primer extension reactions. As such, compositions provided herein can include any additional component known in the art for polymerization compositions, amplification compositions, and/or polynucleotide sequencing compositions. The mutant (e.g. recombinant) DNA polymerase can be present in the composition at a concentration of between 0.1, 0.2, 0.25, 0.5, 0.75, 0.8, 0.9, 1, 5, 6, 8 or 9, on the low end of the range and 1, 5, 6, 7, 8, 9, 10, 20, 25, 50, 75 or 100 mg/ml on the high end of the range. The composition can optionally include a source of nucleotides such as, but not limited to dNTPs, a buffer, salt, and/or a primer. The primer can be present, for example, at concentrations of 10, 20, 25, 50, 75, 100, 125, 150, 200 or 250 uM on the low end of the range, and 50, 75, 100, 125, 150, 200, 250, 500, and 1000 uM on the high end of the range. Nucleotides can be present at any concentration used in the art for polymerization, amplification, and/or sequencing reactions.

Salt, such as, but not limited to, NaCl and/or KCl, can be included in the compositions of the invention. The composition can be a high ionic strength solution. In some embodiments, the composition includes 100, 110, or 120 to 200, 250 or 300 mM salt. In certain embodiments, the composition includes greater than 120 mM salt, such as between 125, 130, 140, or 150 mM salt on the low end of the range, and 150, 160, 170, 175, 180, 190, 200, 225, 250, 275, or 300 mM salt on the high end of the range.

A composition of the invention can further include a solid support. For example, the solid support can be a solid support used in a high throughput sequencing reaction, such as a flow cell, or a population of particles. Such solid support(s) can include a sequencing primer and optionally a clonal or substantially clonal population of template molecules. Accordingly, in certain embodiment, a composition of the invention includes one or more template molecules. In certain embodiments, such template molecules can be one, or typically a set of clonal or substantially clonal populations of template molecules, such as is used in high throughput nucleic acid sequencing.

Kits according to the present invention, in illustrative embodiments, include at least two vessels, such as tubes, or wells in a multi-well plate including a strip of wells, each containing one or more reaction mixture component as provided herein. At least one of the vessels includes a non-naturally occurring mutant (e.g. recombinant) DNA polymerase of the invention and one or more other tubes can include nucleotides and/or a buffer appropriate for one of the methods provided herein, for example. In some embodiments, the kits can be virtual kits wherein a number of separate reagents are listed, marketed and/or sold together, such as on a web page that lists different reagents that can be purchased together.

In some embodiments, a kit useful for performing a nucleic acid polymerization reaction includes a buffer, at least one type of nucleotide, and a non-naturally occurring mutant DNA polymerase, that is typically a recombinant DNA polymerase, and is optionally modified, wherein the polymerase has a polypeptide segment having at least 80%, 85%, 90%, 95%, 96%, 97%, 98%, or 99% sequence identity to SEQ ID NO: 1 or a fragment thereof, exhibits polymerase activity, and includes either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T. The recombinant DNA polymerase can have the property of yielding a lower average systematic error rate when used in a sequencing by synthesis reaction as compared to the average systematic error rate obtained using a reference Bst polymerase, such as wild-type Bst polymerase, the mutant Bst polymerase of SEQ ID NO: 2, or the mutant Bst polymerase of SEQ ID NO: 35, and/or the recombinant DNA polymerase has the property of yielding improved accuracy when used in a sequencing by synthesis reaction as compared to the accuracy obtained using, for example, the aforementioned reference Bst polymerases. The sequencing by synthesis reaction in which the polymerase has improved properties in illustrative examples, is a sequencing reaction in which hydrogen ions are released and detected. The mutant (e.g. recombinant) polymerase in kit embodiments herein, can include amino acid substitutions H46R, E446Q, and H572R, in some embodiments, and/or can include mutations H281M, D423K, and N487R, wherein the numbering is relative to SEQ ID NO: 1.

The mutant (e.g. recombinant) DNA polymerase in the kit embodiments provided herein, can further include one or more of L252R, H473G. and H528T, wherein the numbering is relative to SEQ ID NO: 1). Accordingly, in certain examples provided herein the mutant DNA polymerase in the kit embodiments herein, has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G. and H528T, wherein the numbering is relative to SEQ ID NO: 1. In an exemplary kit embodiment having such mutations, the non-naturally occurring mutant has the sequence of SEQ ID NO: 119.

In further subembodiments, the polypeptide segment of the mutant (e.g. recombinant) DNA polymerase in the embodiments provided above, can be at least 50%, 60%, 70%, 75%, 80%, 90%, 95%, 96%, 97%, 98%, or 99% of the mutant DNA polymerase, and can have at least 75%, 80%, 85%, 90%, 95%, 96%, 97%, 98%, or 99% identity to SEQ ID NO: 1, or SEQ ID NO: 16, which is full length wild-type Bst polymerase. The mutant (e.g. recombinant) DNA polymerase in such kit subembodiments exhibits polymerase activity, can optionally include amino acid substitutions H341R, E741Q, and H867R, and/or can optionally include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary embodiment having such mutations, the mutant DNA Polymerase has the amino acid sequence of SEQ ID NO: 121.

In some embodiments, the kit includes at least one reversible terminator as the at least one type of nucleotide. In some embodiments, the kit includes at least one non-naturally occurring nucleotide as the at least one type of nucleotide. In one embodiment, the at least one non-naturally occurring nucleotide includes dUTP. In some embodiments, the kit includes one or more naturally occurring nucleotides as the at least one type of nucleotide, such as dATP, dGTP, dCTP and dTTP. In one embodiment, the at least one type of nucleotide can include a fluorescently labeled nucleotide. In some embodiments, the kit includes a plurality of reaction vessels in which to perform the nucleic acid polymerization reaction. In another embodiment, the kit includes a single reaction vessel in which the nucleic acid polymerization reaction is performed. The kit may optionally contain other components such as microspheres, beads and/or slides for use during the polymerization reaction. In some embodiments, the buffer can include a detergent selected from the group consisting of a polyoxyethylated sorbitan monolaurate, an ethoxylated nonyl phenol, ethoxylated fatty alcohol ethers, laurylethers, ethoxylated alkyl phenols, octylphenoxy polyethoxy ethanol compounds, modified oxyethylated and/or oxypropylated straight chain alcohols, polyethylene glycol monooleate compounds, polysorbate compounds, and phenolic fatty alcohol ethers or a combination thereof. In some embodiments, the kit useful for performing a nucleic acid polymerization reaction can include a buffer, at least one type of nucleotide, and at least one mutant (e.g. recombinant) polymerase of SEQ ID NOS: 79-119.

In some embodiments, the kit may optionally contain a sequencing primer.

In some embodiments, the kit includes at least one reversible terminator as the at least one type of nucleotide. In some embodiments, the kit includes at least one non-naturally occurring nucleotide as the at least one type of nucleotide. In one embodiment, the at least one non-naturally occurring nucleotide includes dUTP. In some embodiments, the kit includes one or more naturally occurring nucleotides as the at least one type of nucleotide, such as dATP, dGTP, dCTP and dTTP. In one embodiment, the at least one type of nucleotide can include a fluorescently labeled nucleotide. In some embodiments, the kit includes a plurality of reaction vessels in which to perform the nucleic acid polymerization reaction. In another embodiment, the kit includes a single reaction vessel in which the nucleic acid polymerization reaction is performed. The kit may optionally contain other components such as microspheres, beads and/or slides for use during the polymerization reaction. In some embodiments, the buffer can include a detergent selected from the group consisting of a polyoxyethylated sorbitan monolaurate, an ethoxylated nonyl phenol, ethoxylated fatty alcohol ethers, laurylethers, ethoxylated alkyl phenols, octylphenoxy polyethoxy ethanol compounds, modified oxyethylated and/or oxypropylated straight chain alcohols, polyethylene glycol monooleate compounds, polysorbate compounds, and phenolic fatty alcohol ethers or a combination thereof.

In some kit subembodiments, a kit for performing a sequencing by synthesis reaction is provided herein that includes a buffer, at least one type of nucleotide, and a non-naturally occurring mutant DNA polymerase, that is typically a recombinant DNA polymerase, and is optionally modified, wherein the polymerase has a polypeptide segment having at least 80%, 85%, 90%, 95%, 96%, 97%, 98%, or 99% sequence identity to SEQ ID NO: 1 or a fragment thereof, exhibits polymerase activity, and includes either (a) one or more amino acid substitutions selected from the group consisting of E30K, G209Q, E220H or E220T, N234K, P236I or P236R, E245R, L252R, S260K, D264K or D264M, E267M or E267K or E267R, E277T, T324R, E325R, A344Y, E442R or E442Y, E456R, H473G, D480L, N485R, A492K, E493G or E493R, M495C, N517C or N517K, E522C and H528T; or (b) two or more amino acid substitutions selected from E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T. The mutant (e.g. recombinant) DNA polymerase can have the property of yielding a lower average systematic error rate when used in a sequencing by synthesis reaction as compared to the average systematic error rate obtained using a reference Bst polymerase, such as wild-type Bst polymerase, the mutant Bst polymerase of SEQ ID NO: 2, or the mutant Bst polymerase of SEQ ID NO: 35, and/or the recombinant DNA polymerase has the property of yielding improved accuracy when used in a sequencing by synthesis reaction as compared to the accuracy obtained using, for example, the aforementioned reference Bst polymerases. The sequencing by synthesis reaction in which the polymerase has improved properties in illustrative examples, is a sequencing reaction in which hydrogen ions are released and detected. The mutant (e.g. recombinant) polymerase in illustrative sequencing by synthesis kit subembodiments herein, can include amino acid substitutions H46R, E446Q, and H572R, in some embodiments, and/or can include mutations H281M, D423K, and N487R, wherein the numbering is relative to SEQ ID NO: 1.

The mutant (e.g. recombinant) DNA polymerase in illustrative sequencing by synthesis kit subembodiments provided herein, includes one or more of L252R, H473G. and H528T, wherein the numbering is relative to SEQ ID NO: 1. Accordingly, in certain examples provided herein the mutant DNA polymerase in the sequencing by synthesis kit subembodiments herein, has at least 80%, 85%, 90%, 95%, 96%, 97%, 98%, or 99% identity to SEQ ID NO: 1, or a fragment thereof, exhibits polymerase activity, includes amino acid substitutions H46R, E446Q, H572R, H281M, D423K, and N487R, and further includes L252R, H473G, and H528T, wherein the numbering is relative to SEQ ID NO: 1. In an exemplary sequencing by synthesis kit subembodiments having such mutations, the non-naturally occurring mutant has the sequence of SEQ ID NO: 119.

In further sequencing by synthesis kit subembodiments, the polypeptide segment of the mutant (e.g. recombinant) DNA polymerase in such subembodiments can be at least 50%, 60%, 70%, 75%, 80%, 90%, 95%, 96%, 97%, 98%, 99%, or 100% of the mutant DNA polymerase, and can have at least 75%, 80%, 85%, 90%, 95%, 96%, 97%, 98%, or 99% identity to SEQ ID NO: 1 (wild type 581 amino acid fragment), or SEQ ID NO: 16, which is wild-type, full-length Bst polymerase. The mutant (e.g. recombinant) DNA polymerase in such sequencing by synthesis kit subembodiments exhibits polymerase activity, can optionally include amino acid substitutions H341R, E741Q, and H867R, and/or can optionally include mutations H576M, D718K and N782R, and includes one or more of, L547R, H768G and H823T, wherein the numbering is relative to SEQ ID NO: 16. In certain embodiments, the mutant (e.g. recombinant) DNA polymerase includes L547R, H768G, and H823T. In an exemplary embodiment having such mutations, the mutant DNA Polymerase has the amino acid sequence of SEQ ID NO: 121. In some embodiments, the kit for performing a sequencing by synthesis reaction includes a buffer, at least one type of nucleotide, and a recombinant DNA polymerase of SEQ ID NO: 119 or SEQ ID NO: 121.

The mutant (e.g. recombinant) DNA polymerase can be present in the kit at a concentration of between 0.1, 0.2, 0.25, 0.5, 0.75, 0.8, 0.9, 1, 5, 6, 8 or 9, on the low end of the range and 1, 5, 6, 7, 8, 9, 10, 20, 25, 50, 75 or 100 mg/ml on the high end of the range. In some sequencing by synthesis kit subembodiments, the kit optionally contains a sequencing primer. The sequencing primer can be present, for example, at concentrations of 10, 20, 25, 50, 75, 100, 125, 150, 200 or 250 uM on the low end of the range, and 50, 75, 100, 125, 150, 200, 250, 500, and 1000 uM on the high end of the range. Furthermore, the kit, which includes at least 2 containers, can optionally be a multi-well plate, with each well being a separate container, such as a single row strip of wells, can include a solid support, such as sequencing beads or particles, such as Ion Torrent sequencing particles, that include an immobilized primer. Furthermore, the kit can optionally include a detergent solution, and control DNA fragments of known sequence immobilized on the solid support. Furthermore, the kit can include reagents for forming substantially monoclonal templates on the solid support for high throughput sequencing. Such reagents can include a solution primer, at least a portion of which can be biotinylated, for clonal or substantially clonal amplification of template molecules, along with an immobilized primer on the solid support, a competitor primer in a solution, having the same sequence as the immobilized primer and/or a reference template of known sequence. Furthermore, such kit can include in some embodiments, sodium hydroxide and a neutralization solution. In addition, such kits can include reagents for amplification, including PCR and isothermal amplification. For example, the kit can include dried down pellet(s) with reagents for an isothermal reaction such as recombinase polymerase amplification, one or more rehydration buffers, and a source of magnesium ions, such as magnesium acetate (MgOAc). The kit can include any of the mutant (e.g. recombinant) DNA polymerases disclosed herein. In exemplary embodiments, the mutant DNA Polymerase has the amino acid sequence of SEQ ID NO: 119 or SEQ ID NO: 121.

In some embodiments, the kit for performing a sequencing by synthesis reaction includes at least one reversible terminator as the at least one type of nucleotide. In some embodiments, the kit includes at least one non-naturally occurring nucleotide as the at least one type of nucleotide. In one embodiment, the at least one non-naturally occurring nucleotide includes dUTP. In some embodiments, the kit includes one or more naturally occurring nucleotides as the at least one type of nucleotide, such as dATP, dGTP, dCTP and dTTP. In one embodiment, the at least one type of nucleotide can include a fluorescently labeled nucleotide. In some embodiments, the kit includes a plurality of reaction vessels in which to perform the sequencing by synthesis reaction. In another embodiment, the kit includes a single reaction vessel in which the sequencing by synthesis reaction is performed. The kit may optionally contain other components such as microspheres, beads, ISFET chips and/or slides for use during the sequencing by synthesis reaction. In some embodiments, the buffer can include a detergent selected from the group consisting of a polyoxyethylated sorbitan monolaurate, an ethoxylated nonyl phenol, ethoxylated fatty alcohol ethers, laurylethers, ethoxylated alkyl phenols, octylphenoxy polyethoxy ethanol compounds, modified oxyethylated and/or oxypropylated straight chain alcohols, polyethylene glycol monooleate compounds, polysorbate compounds, and phenolic fatty alcohol ethers or a combination thereof.

In some embodiments, a kit for performing a sequencing by synthesis reaction includes a buffer, at least one type of nucleotide, and a recombinant polymerase having at least 80%, 85%, 90%, 95%, 96%, 97%, 98%, 99%, or more identity to SEQ ID NO: 35, or a fragment thereof, where the recombinant polymerase or fragment thereof exhibits polymerase activity, and includes one or more amino acid substitutions selected from the group consisting of E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T, wherein the numbering is relative to SEQ ID NO: 35. In some embodiments, the kit may optionally contain a sequencing primer.

In some embodiments, the kit for performing a sequencing by synthesis reaction includes a buffer, at least one type of nucleotide, and a recombinant polymerase selected from the group consisting of SEQ ID NO: 80, SEQ ID NO: 83, SEQ ID NO: 84, SEQ ID NO: 85, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 105, SEQ ID NO: 106, SEQ ID NO: 107, SEQ ID NO: 108, SEQ ID NO: 109, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118 or SEQ ID NO: 119. In some embodiments, the kit may optionally contain a sequencing primer.

In some embodiments, the kit for performing a sequencing by synthesis reaction includes at least one reversible terminator as the at least one type of nucleotide. In some embodiments, the kit includes at least one non-naturally occurring nucleotide as the at least one type of nucleotide. In one embodiment, the at least one non-naturally occurring nucleotide includes dUTP. In some embodiments, the kit includes one or more naturally occurring nucleotides as the at least one type of nucleotide, such as dATP, dGTP, dCTP and dTTP. In one embodiment, the at least one type of nucleotide can include a fluorescently labeled nucleotide. In some embodiments, the kit includes a plurality of reaction vessels in which to perform the sequencing by synthesis reaction. In another embodiment, the kit includes a single reaction vessel in which the sequencing by synthesis reaction is performed. The kit may optionally contain other components such as microspheres, beads and/or slides for use during the sequencing by synthesis reaction. In some embodiments, the buffer can include a detergent selected from the group consisting of a polyoxyethylated sorbitan monolaurate, an ethoxylated nonyl phenol, ethoxylated fatty alcohol ethers, laurylethers, ethoxylated alkyl phenols, octylphenoxy polyethoxy ethanol compounds, modified oxyethylated and/or oxypropylated straight chain alcohols, polyethylene glycol monooleate compounds, polysorbate compounds, and phenolic fatty alcohol ethers or a combination thereof. In some embodiments, a kit for amplifying a nucleic acid template is contemplated by the instant disclosure. The kit can include any of the reagents disclosed herein for amplifying a nucleic acid template, including any of the mutant (e.g. recombinant) DNA polymerases disclosed herein. In one embodiment, the kit includes a buffer, at least one type of nucleotide, and a recombinant polymerase selected from the group consisting of SEQ ID NO: 39, SEQ ID NO: 42, SEQ ID NO: 43, SEQ ID NO: 44, SEQ ID NO: 46, SEQ ID NO: 47, SEQ ID NO: 48, SEQ ID NO: 49, SEQ ID NO: 50, SEQ ID NO: 51, SEQ ID NO: 52, SEQ ID NO: 54, SEQ ID NO: 55, SEQ ID NO: 57, SEQ ID NO: 58, SEQ ID NO: 59, SEQ ID NO: 60, SEQ ID NO: 61, SEQ ID NO: 62, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 73, SEQ ID NO: 74, SEQ ID NO: 75, SEQ ID NO: 76, SEQ ID NO: 77, SEQ ID NO: 78, or SEQ ID NO: 121.

In another embodiment, the kit includes a buffer, at least one type of nucleotide, and a recombinant polymerase selected from the group consisting of SEQ ID NO: 80, SEQ ID NO: 83, SEQ ID NO: 84, SEQ ID NO: 85, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 105, SEQ ID NO: 106, SEQ ID NO: 107, SEQ ID NO: 108, SEQ ID NO: 109, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118 or SEQ ID NO: 119.

In some embodiments, a buffer in kits and methods herein can be found in buffer compositions that include any one or more of the following a monovalent metal salt, a divalent metal salt, a divalent anion, and a detergent. For example, the buffer composition can include a potassium and/or sodium salt. In some embodiments, the buffer composition can include a manganese and/or magnesium salt. In some embodiments, the buffer composition can include a sulfate such as potassium sulfate and/or magnesium sulfate. In some embodiments, the buffer composition can include a detergent selected from the group consisting of a polyoxyethylated sorbitan monolaurate, an ethoxylated nonyl phenol, ethoxylated fatty alcohol ethers, laurylethers, ethoxylated alkyl phenols, octylphenoxy polyethoxy ethanol compounds, modified oxyethylated and/or oxypropylated straight chain alcohols, polyethylene glycol monooleate compounds, polysorbate compounds, and phenolic fatty alcohol ethers or a combination thereof. In some embodiments, the buffer composition can include a detergent selected from the group consisting of Triton and Tween.

In some embodiments, the buffer composition can include at least one potassium salt, at least one manganese salt, and Triton X-100 (Pierce Biochemicals). The salt can optionally be a chloride salt or a sulfate salt.

In some embodiments, the buffer composition can include at least one potassium salt, at least one magnesium salt, and Triton X-100 (Pierce Biochemicals). The salt can optionally be a chloride salt or a sulfate salt.

In some embodiments, the buffer composition has a pH of about 7.3 to about 8.0, typically about 7.4 to about 7.9.

In some embodiments, the buffer composition includes magnesium or manganese salt at a concentration of between 1 mM and 20 mM, particularly 6-15 mM.

In some embodiments, the buffer composition includes a sulfate at a concentration of between 1 mM and 100 mM, particularly 5-50 mM.

In some embodiments, the buffer composition includes a detergent (e.g., Triton X-100 or Tween-20) at a concentration of between 0.001% to 1%, typically between 0.0025-0.0125%.

In some embodiments, the disclosed modified polymerase compositions, (as well as related methods, systems, apparatuses and kits) can be used to obtain sequence information from a nucleic acid molecule. Many methods of obtaining sequence information from a nucleic acid molecule are known in the art, and it will be readily appreciated that all such methods are within the scope of the present disclosure. Suitable methods of sequencing using the disclosed modified polymerases include without limitation: Sanger sequencing, ligation-based sequencing (also known as sequencing by hybridization) and sequencing by synthesis. Sequencing-by-synthesis methods typically involve template-dependent nucleic acid synthesis (e.g., using a primer that is hybridized to a template nucleic acid or a self-priming template, as will be appreciated by those of ordinary skill), based on the sequence of a template nucleic acid. That is, the sequence of the newly synthesized nucleic acid strand is typically complementary to the sequence of the template nucleic acid and therefore knowledge of the order and identity of nucleotide incorporation into the synthesized strand can provide information about the sequence of the template nucleic acid strand. Sequencing by synthesis using the modified polymerases of the disclosure will typically involve detecting the order and identity of nucleotide incorporation when nucleotides are polymerized in a template-dependent fashion by the modified polymerase. Some exemplary methods of sequence-by-synthesis using labeled nucleotides include single molecule sequencing (see, e.g., U.S. Pat. Nos. 7,329,492 and 7,033,764), which typically involve the use of labeled nucleotides to detecting nucleotide incorporation. In some embodiments, the disclosed polymerase compositions (and related methods, kits, systems and apparatuses) can be used to obtain sequence information for whole genome sequencing, amplicon sequencing, targeted re-sequencing, single molecule sequencing, multiplex or barcoded sequencing, and paired end sequencing applications.

In some embodiments, the disclosed modified polymerase compositions as well as related methods, systems, apparatuses and kits, can be used to amplify nucleic acid molecules. In some embodiments, a nucleic acid molecule can be amplified using a modified polymerase for example by pyrosequencing, polymerase chain reaction, emulsion polymerase chain reaction, bridge polymerase chain reaction, and the like.

In some embodiments, the disclosed modified polymerase compositions (as well as related methods, systems, apparatuses and kits), can be used to generate nucleic acid libraries. In some embodiments, the disclosed modified polymerase compositions can be used to generate nucleic acid libraries for a variety of downstream processes. Many methods for generating nucleic acid libraries are known in the art, and it will be readily appreciated that all such methods are within the scope of the present disclosure. Suitable methods include, without limitation, nucleic acid libraries generated using emulsion PCR, bridge PCR, PCR, qPCR, RT-PCR, and other forms of nucleic acid amplification dependent on polymerization. In some embodiments, the methods can include template-dependent nucleic acid amplification. In some embodiments, the methods can include a primer:template duplex or a nucleic acid template to which the modified polymerase can perform nucleotide incorporation. In some embodiments, the nucleic acid can include a single stranded nucleic acid with a secondary structure such as a hair-pin or stem-loop that can provide a single-stranded overhang to which the modified polymerase can incorporate a nucleotide during polymerization. In some embodiments, methods for generating nucleic acid libraries using one or more of modified polymerases according to the disclosure can include the generation of a nucleic acid library of 50, 100, 200, 300, 400, 500, 600 or more base pairs in length. In some embodiments, the nucleic acid template to which the modified polymerase can perform nucleotide incorporation can be attached, linked or bound to a support, such as a solid support. In some embodiments, the support can include a planar support such as slide. In some embodiments, the support can include a particle, such as an Ion Sphere™ particle (sold by Life Technologies Corp, Calif.).

In some embodiments, the disclosure relates generally to a method for generating a nucleic acid library comprising contacting a nucleic acid template with a modified polymerase and one or more dNTPs under polymerizing conditions; thereby incorporating one or more dNTPs into the nucleic acid template to generate a nucleic acid library. In some embodiments, the method can further include generating a nucleic acid library or sequencing a nucleic acid library in the presence of a high ionic strength solution. In some embodiments, the disclosure relates generally to a modified polymerase that retains polymerase activity in the presence of high ionic strength solution. In some embodiments, the high ionic strength solution can be 150 mM Salt. In some embodiments, the high ionic strength solution can include 125 mM to 175 mM salt. In some embodiments, the high ionic strength solution can be 130 mM salt. In some embodiments, the high ionic strength solution can be from 125 mM to 175 mM salt. In some embodiments, the salt can include a potassium and/or sodium salt. In some embodiments, the ionic strength solution can further include a sulfate. In some embodiments, a modified polymerase is capable of amplifying (and/or sequencing) a nucleic acid molecule in the presence of a high ionic strength solution to a greater capacity (for example as measured by raw accuracy or homopolymer accuracy) than a reference polymerase lacking one or more of the same mutations (or homologous mutations) under identical conditions. In some embodiments, a modified polymerase is capable of amplifying (and/or sequencing) a nucleic acid molecule in the presence of a high ionic strength solution to a greater capacity (for example as measured by raw accuracy of homopolymer accuracy) than a reference polymerase lacking one or more of the mutations (or homologous mutations) under standard (i.e., typical) ionic strength conditions (i.e., lower than the high ionic strength solution provided herein, for example 50 mM salt).

Optionally, the method further includes repeating the addition of one or more dNTPs under polymerizing conditions to incorporate a plurality of dNTPs into the nucleic acid template to generate the nucleic acid library. In some embodiments, the method includes detecting the addition of the one or more dNTPs under polymerizing conditions. In some embodiment, the method includes identifying the addition of the one or more dNTPs under polymerizing conditions (e.g., A, G, C, T, A nucleotide flow and nucleotide incorporation).

In some embodiments, the method can further include detecting a nucleotide incorporation by-product during the polymerization. In some embodiments, the nucleotide incorporation by-product can include a hydrogen, pyrophosphate or phosphate ion.

In some embodiments, the method further includes determining the identity of the incorporated dNTPs in the nucleic acid library. In some embodiments, the method further includes determining the number of incorporated nucleotides in the nucleic acid library. In some embodiments, the detecting can further include sequencing the nucleic acid library.

In some embodiments, the disclosed modified polymerase compositions, (as well as related methods, systems, apparatuses and kits) can be used to detect nucleotide incorporation through the generation of by-product formation during the nucleotide incorporation event. Many methods of detecting nucleotide incorporation by-products are known in the art, and it will be readily appreciated that all such methods are within the scope of the present disclosure. Suitable methods of nucleotide by-product detection include without limitation, detection of hydrogen ion, inorganic phosphate, inorganic pyrophosphate, and the like. Several of these by-product detection methods typically involve template-dependent nucleotide incorporation.

In some embodiments, the modified polymerases can be used to perform label-free nucleic acid sequencing, and in particular, ion-based nucleic acid sequencing. The concept of label-free nucleic acid sequencing, including ion-based nucleic acid sequencing, including the following references that are incorporated by reference: Rothberg et al, U.S. Patent Publication Nos. 2009/0026082, 2009/0127589, 2010/0301398, 2010/0300895, 2010/0300559, 2010/0197507, and 2010/0137143, which are incorporated by reference herein in their entireties. Briefly, in such nucleic acid sequencing applications, nucleotide incorporations are determined by detecting the presence of natural byproducts of polymerase-catalyzed nucleic acid synthesis reactions, including hydrogen ions, polyphosphates, PPi, and Pi (e.g., in the presence of pyrophosphatase).

In a typical embodiment of ion-based nucleic acid sequencing, nucleotide incorporations are detected by detecting the presence and/or concentration of hydrogen ions generated by polymerase-catalyzed nucleic acid synthesis reactions, including for example primer extension reactions. In one embodiment, templates that are operably bound to a primer and a polymerase and that are situated within reaction chambers (such as the microwells disclosed in Rothberg et al, cited above), are subjected to repeated cycles of polymerase-catalyzed nucleotide addition to the primer ("adding step") followed by washing ("washing step"). In some embodiments, such templates may be attached as clonal populations to a solid support, such as a microparticle, bead, or the like, and said clonal populations are loaded into reaction chambers. As used herein, "operably bound" means that a primer is annealed to a template so that the primer can be extended by a polymerase and that a polymerase is bound to such primer-template duplex, or in close proximity thereof so that primer extension takes place whenever nucleotides are supplied.

In each adding step of the cycle, the polymerase extends the primer by incorporating added nucleotide in a template-dependent fashion, such that the nucleotide is incorporated only if the next base in the template is the complement of the added nucleotide. If there is one complementary base, there is one incorporation, if two, there are two incorporations, if three, there are three incorporations, and so on. Wth each such incorporation there is a hydrogen ion released, and collectively a population of templates releasing hydrogen ions changes the local pH of the reaction chamber. In some embodiments, the production of hydrogen ions is proportional to (e.g., monotonically related) to the number of contiguous complementary bases in the template (as well as the total number of template molecules with primer and polymerase that participate in an extension reaction). Thus, when there are a number of contiguous identical complementary bases in the template (i.e. a homopolymer (HP) region), the number of hydrogen ions generated, and therefore the magnitude of the local pH change, is proportional to the number of contiguous identical complementary bases. If the next base in the template is not complementary to the added nucleotide, then no incorporation occurs and no hydrogen ion is released. In some embodiments, after each step of adding a nucleotide, a washing step is performed, in which an unbuffered wash solution at a predetermined pH is used to remove the nucleotide of the previous step in order to prevent misincorporations in later cycles. In some embodiments, after each step of adding a nucleotide, an additional step may be performed wherein the reaction chambers are treated with a nucleotide-destroying agent, such as apyrase, to eliminate any residual nucleotides remaining in the chamber, thereby minimizing the probability of spurious extensions in subsequent cycles. In some embodiments, the treatment may be included as part of the washing step itself.

In one exemplary embodiment, different kinds (or "types") of nucleotides are added sequentially to the reaction chambers, so that each reaction is exposed to the different nucleotide types one at a time. For example, nucleotide types can be added in the following sequence: dATP, dCTP, dGTP, dTTP, dATP, dCTP, dGTP, dTTP, and so on; with each exposure followed by a wash step. The cycles may be repeated for 50 times, 100 times, 200 times, 300 times, 400 times, 500 times, 750 times, or more, depending on the length of sequence information desired. In some embodiments, the time taken to apply each nucleotide sequentially to the reaction chamber (i.e. flow cycle) can be varied depending on the sequencing information desired. For example, the flow cycle can in some instances be reduced when sequencing long nucleic acid molecules to reduce the overall time needed to sequence the entire nucleic acid molecule. In some embodiments, the flow cycle can be increased, for example when sequencing short nucleic acids or amplicons. In some embodiments, the flow cycle can be about 0.3 seconds to about 3 seconds, and more typically about 0.5 second to about 1.5 seconds.

In one exemplary embodiment, the disclosure relates generally to a method for obtaining sequence information from a nucleic acid template, and includes the following: (a) providing a reaction mixture including a template nucleic acid hybridized to a sequencing primer and bound to a modified polymerase, wherein the modified polymerase comprises a polymerase linked to a bridging moiety through one or more attachment sites within the polymerase; (b) contacting the template nucleic acid with a nucleotide, wherein the contacting includes incorporating the nucleotide into the sequencing primer and generating a sequencing byproduct if the nucleotide is complementary to a corresponding nucleotide in the template nucleic acid; and (c) detecting the presence of sequencing byproduct in the reaction mixture, thereby determining whether nucleotide incorporation has occurred.

In some embodiments, the method can further include repeating the contacting and detecting steps at least once. In some embodiments, these steps are repeated between 2, 3, 4, 5, 6, 7, 8, 9, 10, 15, 20, 25, 50, 100, 250, 500, or 1000 times on the low end of the range and 10, 15, 20, 25, 50, 100, 250, 500, 1000, 2500, 5000, 10000, 25000, 50000, or 100,000 times on the high end of the range.

In some embodiments, the polymerase of the modified polymerase includes a single attachment site, and the bridging moiety is linked to the polymerase through the single attachment site, either directly or through a linking moiety. In some embodiments, the single attachment site can be linked to a biotin moiety, and the bridging moiety can include an avidin moiety. In some embodiments, the modified polymerase exhibits increased read length and/or processivity relative to an unmodified form of the polymerase under otherwise similar or identical reaction conditions.

In some embodiments, detecting the presence of the sequencing byproduct includes contacting the reaction mixture with a sensor capable of sensing the presence of the sequencing byproduct. The sensor can include a field effect transistor, for example a chemFET or an ISFET.

In some embodiments, the sequencing byproduct includes a hydrogen ion, a dye-linked moiety, a polyphosphate, a pyrophosphate or a phosphate moiety, and detecting the presence of the sequencing byproduct includes using an ISFET to detect the sequencing byproduct. In some embodiments, the detecting the sequencing byproduct includes detecting a hydrogen ion using the ISFET.

In a further embodiment, the disclosure relates generally to a method of detecting a nucleotide incorporation, and includes the following: (a) performing a nucleotide incorporation using a mutated and typically recombinant polymerase provided herein, and generating one or more byproducts of the nucleotide incorporation; and (b) detecting the presence of at least one of the one or more byproducts of the nucleotide incorporation, thereby detecting the nucleotide incorporation.

In some embodiments, the modified polymerase includes a polymerase linked to a bridging moiety. The bridging moiety is optionally linked to the polymerase through one or more attachment sites within the modified polymerase. In some embodiments, the bridging moiety is linked to the polymerase through a linking moiety. The linking moiety can be linked to at least one of the one or more attachment sites of the polymerase. In some embodiments, the polymerase of the modified polymerase includes a single attachment site, and the bridging moiety is linked to the polymerase through the single attachment site, either directly or through a linking moiety. In some embodiments, the single attachment site can be linked to a biotin moiety, and the bridging moiety can include an avidin moiety. In some embodiments, the bridging moiety is linked to the polymerase through at least one biotin-avidin bond. In some embodiments, the modified polymerase exhibits increased read length and/or processivity and/or read accuracy, increased total throughput, reduced strand bias, lowered systematic error, increased relative to a reference polymerase under otherwise similar or identical reaction conditions.

In some embodiments, the method can further include repeating the performing and detecting steps at least once. In some embodiments, these steps are repeated between 2, 3, 4, 5, 6, 7, 8, 9, 10, 15, 20, 25, 50, 100, 250, 500, or 1000 times on the low end of the range and 10, 15, 20, 25, 50, 100, 250, 500, 1000, 2500, 5000, 10000, 25000, 50000, or 100,000 times on the high end of the range.

In some embodiments, detecting the presence of the at least one byproduct of nucleotide incorporation includes using a sensor capable of sensing the presence of the byproduct. The sensor can include a field effect transistor, for example a chemFET or an ISFET.

In some embodiments, the at least one byproduct of nucleotide incorporation includes a hydrogen ion, a dye-linked moiety, a polyphosphate, a pyrophosphate or a phosphate moiety, and detecting the presence of the at least one byproduct includes using an ISFET to detect the at least one byproduct. In some embodiments, the at least one byproduct includes a hydrogen ion, and detecting the presence of the sequencing byproduct includes detecting the hydrogen ion using an ISFET.

In some embodiments, the disclosure relates generally to a method of detecting a change in ion concentration during a nucleotide polymerization reaction, and includes the following: (a) performing a nucleotide polymerization reaction using a mutated and typically recombinant polymerase including a polymerase linked to a bridging moiety, wherein the concentration of at least one type of ion changes during the course of the nucleotide polymerization reaction; and (b) detecting a signal indicating the change in concentration of the at least one type of ion.

In some embodiments, the bridging moiety is linked to the polymerase through one or more attachment sites within the modified polymerase. In some embodiments, the bridging moiety is linked to the polymerase through a linking moiety. The linking moiety can be linked to at least one of the one or more attachment sites of the polymerase. In some embodiments, the polymerase of the modified polymerase includes a single attachment site, and the bridging moiety is linked to the polymerase through the single attachment site, either directly or through a linking moiety. In some embodiments, the single attachment site can be linked to a biotin moiety, and the bridging moiety can include an avidin moiety. In some embodiments, the bridging moiety is linked to the polymerase through at least one biotin-avidin bond. In some embodiments, the modified polymerase exhibits increased read length and/or processivity relative to a reference form of the polymerase under otherwise similar or identical reaction conditions.

In some embodiments, the method can further include repeating the performing and detecting steps at least once.

In some embodiments, detecting the change in concentration of the at least one type of ion includes using a sensor capable of sensing the presence of the byproduct. The sensor can include a field effect transistor, for example a chemFET or an ISFET.

In some embodiments, the at least type of ion includes a hydrogen ion, a dye-linked moiety, a polyphosphate, a pyrophosphate or a phosphate moiety, and detecting the change in concentration of the at least one type of ion includes using an ISFET to detect the at least one type of ion. In some embodiments, the at least one type of ion includes a hydrogen ion, and detecting the presence of the at least one type of ion includes detecting the hydrogen ion using an ISFET.

In one exemplary embodiment, the disclosure relates generally to a method for obtaining sequence information from a nucleic acid template, and includes the following: (a) providing a reaction mixture including a template nucleic acid hybridized to a sequencing primer and bound to a mutate and typically recombinant polymerase provided herein; (b) contacting the template nucleic acid with a nucleotide, wherein the contacting includes incorporating the nucleotide into the sequencing primer and generating a extended primer product; and (c) detecting the presence of the extended primer product in the reaction mixture, thereby determining whether nucleotide incorporation has occurred. In some embodiments, the modified polymerase comprises SEQ ID NO: 2, SEQ ID NO: 24, SEQ ID NO: 26, SEQ ID NO: 28, SEQ ID NO: 31, SEQ ID NO: 32, SEQ ID NO: 34, SEQ ID NO; 35, SEQ ID NO: 36 or SEQ ID NO: 37.

In one exemplary embodiment, the disclosure relates generally to a method for amplifying a nucleic acid template, and includes the following: (a) providing a reaction mixture including a nucleic acid template hybridized to a primer and bound to a mutated and typically recombinant polymerase provided herein; (b) contacting the nucleic acid template with a nucleotide, wherein the contacting includes incorporating the nucleotide into the primer and generating a extended primer product; and (c) detecting the presence of the extended primer product in the reaction mixture, thereby determining whether nucleotide incorporation has occurred. In some embodiments, the modified polymerase include SEQ ID NO: 119, SEQ ID NO: 121, SEQ ID NO: 1, SEQ ID NO: 2, SEQ ID NO: 35, SEQ ID NO: 31, SEQ ID NO: 78, SEQ ID NO: 120, and SEQ ID NO: 122 wherein: SEQ ID NO: 1, SEQ ID NO: 2 and SEQ ID NO: 35 include one or more amino acid substitutions selected from the group consisting of E30K, G209Q, E220H, E220K or E220T, N234K or N234R, P236I or P236R, V241K, E245R, V251R, L252R, S260K, D264K or D264M, E267M or E267K or E267R, E277T, E294K, T324R, E325R, A344Y, E442R or E442Y, E456R, H473G, D480L or D480R, N485R, A492K, E493G or E493R, M495C, N517C or N517K, E522C and H528T; and SEQ ID NO: 31, SEQ ID NO: 120, and SEQ ID NO: 122 include one or more amino acid substitutions selected from the group consisting of E325K, G504Q, N529K or N529R, P5311 or P531R, V536K, V546R, L547R, E515H or E515K or E515T, E540R, S555K, D559K or D559M, E562M or E562K or E562R, E572T, E589K, T619R, E620R, A639Y, E751R, E737R, E737Y, H768G, M790C, A787K, D775L, D775R, N780R, E788G or E788R, N812C or N812K, E817C, and H823T.

The following non-limiting examples are provided purely by way of illustration of exemplary embodiments, and in no way limit the scope and spirit of the present disclosure. Furthermore, it is to be understood that any inventions disclosed or claimed herein encompass all variations, combinations, and permutations of any one or more features described herein. Any one or more features may be explicitly excluded from the claims even if the specific exclusion is not set forth explicitly herein. It should also be understood that disclosure of a reagent for use in a method is intended to be synonymous with (and provide support for) that method involving the use of that reagent, according either to the specific methods disclosed herein, or other methods known in the art unless one of ordinary skill in the art would understand otherwise. In addition, where the specification and/or claims disclose a method, any one or more of the reagents disclosed herein may be used in the method, unless one of ordinary skill in the art would understand otherwise.

EXAMPLES

Example 1: Purification of Exemplary Mutant Polymerases

Various exemplary mutations can be introduced via site-directed mutagenesis into an exemplary reference polymerase having the amino acid sequence of SEQ ID NO: 1, which is a 581 amino acid wild-type fragment of Bst DNA polymerase, SEQ ID NO: 2, which is a 581 amino acid mutant fragment of Bst DNA polymerase having the mutations H46R, E446Q and H572R (numbering relative to SEQ ID NO: 1 and SEQ ID NO: 2) or SEQ ID NO: 35, which is a 581 amino acid mutant fragment of Bst DNA polymerase having the mutations H46R, E446Q, H572R, H281M, D423K, and N487R (numbering relative to SEQ ID NO: 1 and SEQ ID NO: 2). Furthermore, mutations can be introduced into an exemplary reference polymerase having the amino acid sequence of SEQ ID NO: 16, which is the full length wild-type Bst DNA polymerase, as well as reference mutant Bst DNA polymerases, such as those with mutations at corresponding sites in the full-length Bst DNA polymerase as those sites indicated above for the 581 amino acid Bst DNA polymerase fragment. Recombinant expression constructs encoding mutated/further mutated polymerases can be transformed into bacteria. Colonies containing expression constructs can be inoculated into BRM media, grown to OD=0.600 and induced by adding IPTG to a final concentration of 1 mM. The cells can be then grown for a further 3 hours at 37° C.

The induced cells can be centrifuged for 10 minutes at 6000 rpm, supernatant can be discarded, and the cells can be resuspended in resuspension buffer (10 mM Tris, pH 7.5, 100 mM NaCl). The resuspended cells can be sonicated at a setting of 60 (amplitude) for one minute, and then placed on ice for 1 minute. The sonication can be repeated in this manner for a total of 5 times.

The samples can be incubated at 65° C. for 10 minutes. The samples can be centrifuged at 9000 rpm for 30 minutes. The supernatant can be recovered and further purified over a Heparin column.

Example 2: Comparing Performance of Modified and Reference Polymerases in Nucleic Acid Sequencing A wild-type or mutant Bst polymerase including any of the mutations disclosed herein can be purified essentially as described in Example 1 and tested as or along with a reference polymerase (for example having the amino acid sequence of SEQ ID NO: 2 or SEQ ID NO: 35) (control reaction) and evaluated for performance in an ion-based sequencing reaction using the Ion Torrent PGM™ Sequencing system (Ion Torrent Systems, Part No. 4462917). Briefly, genomic DNA can be purified, adapter-ligated and size selected as described in User Guide for the Ion Fragment Library Kit (Ion Torrent Systems, Part No. 4466464; Publication Part No. 4467320 Rev B). The DNA fragments can then amplified onto Ion Sphere™ particles (Ion Torrent Systems, Part No. 602-1075-01) essentially according to the protocols provided in the User Guide for the Ion Xpress™ Template Kit v 2.0 (Ion Torrent Systems, Part No. 4469004A) and using the reagents provided in the Ion Template Preparation Kit (Ion Torrent Systems/Life Technologies, Part No. 4466461), the Ion Template Reagents Kit (Ion Torrent Systems/Life Technologies, Part No. 4466462) and the Ion Template Solutions Kit (Ion Torrent Systems/ Life Technologies, Part No. 4466463). The amplified DNA can then loaded into a PGM™ 314 sequencing chip. The chip can be loaded into an Ion Torrent PGM™ Sequencing system (Ion Torrent Systems/Life Technologies, Part No. 4462917) and sequenced essentially according to the protocols provided in User Guide for the Ion Sequencing Kit v2.0 (Ion Torrent Systems/Life Technologies, Part No. 4469714 Rev A) and using the reagents provided in the Ion Sequencing Kit v2.0 (Ion Torrent Systems/Life Technologies, Part No. 4466456) with a reference or a mutant polymerases provided herein and the Ion Chip Kit (Ion Torrent Systems/Life Technologies, Part No. 4462923). Ion Torrent Systems is a subsidiary of Life Technologies Corp., Carlsbad, Calif.).

The resulting sets of sequencing reads using reference and mutant polymerases can be analyzed, for example to measure the raw read accuracy of the resulting sequencing reads (as reported by the Ion Torrent standard software provided with the Ion Torrent Sequencing System), the number of 50Q17 reads, 100Q17 reads, and 200Q17 reads. Using the standard software supplied with the PGM™ sequencing system, the total number of 100Q17 or 200Q17 reads obtained in sequencing reactions using reference and modified polymerases can be measured and compared.

Example 3: Transfer of Mutations from One Modified Polymerase to Another Polymerase This example demonstrates, as has been published in WO2015/048763, that Bst polymerase mutations with certain properties can be "transferred" to Taq polymerase by creating Taq mutants, or Klenow fragment mutants, of an analogous residue(s). Various exemplary mutations were introduced via site-directed mutagenesis into exemplary reference polymerases having the amino acid sequences of SEQ ID NO: 2, SEQ ID NO: 16, SEQ ID NO: 15 and SEQ ID NO: 18 (See Table 1). After sequence verification, the modified polymerases containing amino acid mutations (e.g., a Taq DNA polymerase having amino acid mutation D732R, wherein the numbering corresponds to SEQ ID NO. 15; and a Klenow fragment DNA polymerase having amino acid mutation D505R, wherein the numbering corresponds to SEQ ID NO. 18) were transformed into bacterial cells for expression. Colonies containing expression construct were inoculated into BRM media, grown to OD=0.600 and induced by adding IPTG to a final concentration of 1 mM. The cells were then grown for a further 3 hours at 37° C.

The induced cells were then centrifuged for 10 minutes at 6000 rpm, supernatant was discarded, and the cells were resuspended in resuspension buffer (100 mM Tris, pH 7.5, 100 mM NaCl). The resuspended cells were sonicated at a setting of 60 (amplitude) for one minute, and then placed on ice for 1 minute. The sonication was repeated in this manner for a total of 5 times. Samples were incubated at 65° C. for 10 minutes and centrifuged at 9000 rpm. The supernatant was recovered and further purified over a Heparin column.
Heparin DNA Affinity column The following results were observed during purification of the modified polymerases on a Heparin column. All mutants exhibited tighter binding to a heparin column. Taq D732R came off the column at a conductivity of 43 mS/cm where the wild type comes off at 39 mS/cm. Klenow D505R came off the column at a conductivity of 47 mS/cm where wild type Klenow comes off at 32 mS/cm.
Template Affinity/Dissociation Assay:

The dissociation rate of each modified and reference polymerase from a DNA template (oligo 221) in the presence of excess competitor DNA (hairpin oligo 173) was measured. Decreasing fluorescence is monitored over time on a spectrophotometer as the polymerase dissociates from the fluorescein-labeled template. The dissociation rate is calculated by fitting the data to a one-phase exponential decay equation.

Representative results of an assay where the dissociation rate constant (also referred to as the "dissociation time constant") of various modified polymerases, as well as reference polymerases having the amino acid sequence of SEQ ID NO: 2 or SEQ ID NO: 18, was measured at time intervals (depicted in FIG. 2). The polymerases included in the assay are represented in FIG. 2 as follows: Bst 1.0=Reference polymerase having the amino acid sequence of SEQ ID NO: 2; BST D775R=modified polymerase having the amino acid sequence of SEQ ID NO: 2 and further including the mutation D775R; Klenow WT=reference polymerase having the amino acid sequence of SEQ ID NO: 18; Klenow D505R=modified polymerase having the amino acid sequence of SEQ ID NO: 18 and further including the mutation D505R. As indicated in FIG. 2, the modified polymerases exhibited significantly higher dissociation time constants as compared with the corresponding reference polymerase.

Example 4: Construction of Exemplary Modified Polymerases

Various exemplary mutations can be introduced via site-directed mutagenesis into an exemplary reference polymerase, such as a polymerase having the amino acid sequence of SEQ ID NO: 1 (581 amino acid wild-type Bst DNA polymerase fragment), or reference mutants thereof such as those having the amino acid sequence of SEQ ID NO: 2 or SEQ ID NO: 35; or exemplary reference polymerase having the amino acid sequence of SEQ ID NO: 16 (full length wild-type Bst DNA polymerase), or reference mutants thereof such as those having the amino acid sequence of SEQ ID NO: 122 or SEQ ID NO: 120. This example outlines an exemplary high-throughput method that can be used to generate a library of mutant polymerases or biological active fragments thereof. The examples herein also outline methods to assess such mutated polymerases or biologically active fragments for polymerase activity, or various aspects of a sequencing reaction indirectly related to such polymerase activity.

In this example, a mutagenized library of constructs can be prepared that adds mutations to a reference polymerase such as any of the reference polymerases discussed immediately above where every amino acid in the polymerase can be individually mutated, or any of the mutants disclosed in these examples herein, can be created. Additionally, in an illustrative example, select amino acid residues can be mutated with every possible combination of amino acids at the selected amino acid residues. The resulting library of mutant constructs can then be applied to a number of 96-well plates where the mutant constructs can be grown in BRM media overnight at 30° C. Media containing the mutant constructs can be inoculated into deep 96-well plates and grown for 3 hours at 37° C. and induced by adding IPTG to a final concentration of 1 mM. The cells can then be grown for a further 3 hours at 37° C. The induced cells can then be centrifuged for 10 minutes at 3700 rpm, supernatant can be discarded, and the cells can be resuspended in 100 µl resuspension buffer (10 mM Tris, pH 7.5, 100 mM NaCl). The resuspended cells can be sonicated at a setting of 60 (amplitude) for one minute, and then placed at 80° C. overnight.

The above samples can be incubated at 65° C. for 10 minutes. The samples can then be centrifuged at 3700 rpm for 12 minutes. The supernatant was recovered and further purified with Affinity resin and myOne beads using a biotinylated capture oligonucleotide. The purified mutated polymerases or biologically active fragments can be eluted in high NaCl and buffer exchanged. The purified mutant polymerases or biologically active fragments can then be assayed to measure various polymerase activities such as signal-to-noise ratio, systematic error, read length, raw accuracy, strand bias and total sequencing throughput as outlined in the examples below.

Example 5: Assessing Systematic Error

This example provides a method to assess error generally associated with premature attenuation in one or both strands, extreme strand bias, systematic strand error and high GC content. It will be readily apparent to the skilled artisan that the method disclosed herein can be modified to assess other metrics associated with systematic error, or can be modified to measure one or more other metrics associated with polymerase activity such as template dissociation constant.

Purified polymerases or biologically active fragments thereof can be prepared essentially according to Example 1 or Example 4 and used to assess systematic error using a Personal Genome Machine and Ion PGM 318 Chips, or an Ion Torrent Proton or S5 instrument (Life Technologies Corp, Calif.).

A mutant polymerase, or biologically active fragment thereof, or a library of mutant polymerases or biologically active fragments thereof can be directly compared to a reference sequence, such as a base (i.e. reference) mutant Bst polymerase that includes some but not all of the mutations of the on-test mutant (acting as a control) for performance in an ion-based sequencing system such as the Ion Torrent sequencing by synthesis system. The nucleic acid libraries obtained from the emulsion PCR (emPCR) reactions can be applied downstream in an ion-based sequencing reaction using the Ion Torrent PGM™ sequencing system (Ion Torrent Systems, Part No. 446462917). Briefly, the template DNA can be purified, adapter-ligated and size selected as described in User Guide for the Ion Fragment Library Kit (Ion Torrent Systems, Part No. 44646646464; Publication Part No. 446467320 Rev B). The template DNA can be amplified onto Ion Sphere™ particles in an emulsion PCR reaction as outlined below. The nucleic acid library used in the 96-well emulsion PCR reactions can include 24 nucleic acid templates that had previously been shown to yield a premature attenuation on one strand in an ion-based sequencing by synthesis reaction with reference Bst polymerase; 12 nucleic acid templates that had previously been shown to result in a premature attenuation on both strands when used in an ion-based sequencing by synthesis reaction with reference Bst polymerase; 12 nucleic acid templates that that had previously been shown to yield extreme strand bias when used in an ion-based sequencing by synthesis reaction with reference Bst polymerase; 24 nucleic acid templates that had previously been shown to yield increased systematic strand error when used in an ion-based sequencing by synthesis reaction with reference Bst polymerase; 12 nucleic acid templates that contained high GC content which can cause reduced accuracy when used in an ion-based sequencing by synthesis reaction with reference Bst polymerase; and 12 nucleic acid templates that regularly performed well under the proposed and tested sequencing conditions when used in an ion-based sequencing by synthesis reaction with reference Bst polymerase. Emulsion PCR can be performed using the above 96 template library according to standard emulsion PCR conditions and solutions for Ion Torrent sequencing sample preparation (Life Technologies, Carlsbad, Calif.) according to manufacturer's instructions.

Ion Sphere Particles (ISPs, 20-40 Million) from each of the above 96 barcoded emulsion PCR reactions can be added separately to individual PCR tubes. The tubes can then be filled with annealing buffer and vortexed. The tubes can be spun at max speed (16,500 RPM) for 4 minutes in a table top centrifuge and supernatant can be removed. Sequencing primer can be added, mixed by pipetting, and annealed to beads by thermocycling. The resuspended primer-annealed ISPs can be added to each well of the 96-well plate to yield 400,000 beads per well. Individual reference or on-test mutagenized polymerases or biologically active fragments thereof can be added to each well, with only 1 reference or mutant polymerase or biologically active fragment added per well. The mutant polymerases (or biologically active fragments thereof) and ISPs can be incubated at room temperature for 40 min followed by the addition of a mixture of α-thio dGTP/α-thio dTTP to allow for binding of the reference or on-test mutant polymerase to the ISP. All 96 wells can be combined into a reservoir, transferred to a 2 ml tube, and spun at maximum speed for 3 minutes. The supernatant can be removed, the tube vortexed briefly, and then placed tube on a magnetic block. The sample can be incubated on the magnetic block for 30 seconds, the supernatant can be removed and the entire sample can be loaded onto an Ion 318 Chip (Life Technologies, CA, Catalog No. 4484354) using the standard loading protocol provided by the manufacturer. After loading is complete, the chip can be washed by pipetting wash solution through the loading port. The wash step can be repeated twice, for a total of 3 washes. All liquid can be removed from the chip prior to loading on the Ion PGM (Life Technologies, Carlsbad, Calif., Catalog No. 446462921) and sequenced with the standard Sequencing 400 kit (Life Technologies, Carlsbad, Calif., Catalog No. 4482002) according to the manufacturer's instructions. Accordingly, the reference or on-test mutant polymerase bound to the ISP, is the polymerase that performs the sequencing reaction.

The resulting sequencing runs obtained from the library of mutagenized polymerases or biologically active fragments can be assessed for systematic error. In particular, metrics such as AQ 20 total base count (total sequencing throughput), AQ20 mean, raw read accuracy, strand bias (target bases with no strand bias), and percentage systematic error (measured in Examples that refer to this Example, as percentage of stochastic errors in sequence motifs containing homopolymers of length 1-6, with systematic deletion occurring on strand with a frequency greater than 15%, when coverage (of the sequencing run) is equal to or greater than 20x) can be measured. Optionally, some of the mutant polymerases can be further evaluated using the same metrics against other known polymerases, in addition to direct comparison to a reference polymerase that includes some of the same mutations as the on-test mutant polymerase.

Example 6: Creation and Identification of Mutant Bst DNA Polymerases Having Improved Properties in Nucleic Acid Sequencing A reference (control) polymerase consisting of SEQ ID NO: 35 was used to generate a mutagenic library of polymerases essentially as described in Example 4. The library of mutagenic polymerases were screened according to Example 5 to assess various polymerase activities including accuracy and systematic error, as measured by average AQ20 read length, average raw read accuracy, accuracy for 6-base or 7-base homopolymers, average systematic error (SSE) and average mean read length (MRL).

From the prepared mutagenic library (containing a plurality of single amino acid residue substitutions), several amino acid mutations were observed to outperform the control polymerase under identical sequencing conditions (as measured by accuracy and systematic error). As a result, additional mutant polymerases were prepared essentially as described in Example 4, which contained combinations of various amino acid substitutions that outperformed the control polymerase in the sequencing reactions to produce a plurality of mutant polymerases having one, two, or three amino acid substitutions as compared to SEQ ID NO: 35.

SEQ ID NO: 35 is a mutant polymerase (referred to herein as "PSP4") having three amino acid substitutions as compared to SEQ ID NO: 2. The mutant polymerase of SEQ ID NO: 35 consists of amino acid substitutions D423K, N487R and H281M as compared to SEQ ID NO: 2.

In the following experiment, the reference (control) polymerase used to assess accuracy and systematic error in nucleic acid sequencing reactions (as measured by average systematic error (ave SSE) and average AQ20 mean read length (MRL)) was SEQ ID NO. 35.

Here, six, 96-well plates were prepared essentially according to Example 5 using SEQ ID NO: 35 as the reference (control) polymerase. Sequencing data from each 96-well plate was assessed to identify improved mutant sequencing polymerases as measured by either average systematic error (ave SSE) or average AQ20 mean read length (MRL) as compared to the reference (i.e. control) polymerase (SEQ ID NO: 35 (PSP4)).

FIGS. 3A-3F provide sequencing data for each of the mutant polymerases, which showed improved sequencing performance as compared to the control polymerase (PSP4), as measured by average SSE or average AQ20 MRL. Each of the six, 96-well plates identified a plurality of amino acid residues that when mutated, showed improved performance in a sequencing-by-synthesis reaction when used as part of a sequencing-by-synthesis system, such as an Ion Torrent Sequencing system, as measured by improved accuracy and/or reduced systematic error as compared to the control polymerase (PSP4).

Additionally, some amino acid residues subjected to site-directed mutagenesis created a plurality of improved polymerases at a single amino acid residue of SEQ ID NO: 35. For example, Plate 1 (FIG. 3A) identified amino acid residue 234 of SEQ ID NO: 35 as having improved sequencing function as measured by both average SSE and average AQ20 MRL when amino acids lysine (K) or arginine (R) were substituted for asparagine. Plate 2 (FIG. 3B) identified amino acid residue 267 of SEQ ID NO: 35 as having improved sequencing function as measured by both average SSE and average AQ20 MRL when amino acids methionine (M), lysine (K) or arginine (R) were substituted for glutamic acid. Plate 3 (FIG. 3C) identified amino acid residue 442 of SEQ ID NO: 35 as having improved sequencing function as measured by both average SSE and average AQ20 MRL when amino acids tyrosine (Y) or arginine (R) were substituted for glutamic acid. Plate 4 (FIG. 3D) identified amino acid residue 480 of SEQ ID NO: 35 as having improved sequencing function as measured by both average SSE and average AQ20 MRL when amino acids leucine (L) or arginine (R) were substituted for aspartic acid. Plate 5 (FIG. 3E) identified amino acid residue 517 of SEQ ID NO: 35 as having improved sequencing function as measured by both average SSE and average AQ20 MRL when amino acids cysteine (C) or lysine (K) were introduced for asparagine. Plate 6 (FIG. 3F) identified amino acid residue 264 of SEQ ID NO: 35 as having improved properties in a sequencing reaction as measured by both average SSE and average AQ20 MRL when amino acids methionine (M) or lysine (K) were introduced for aspartic acid.

Example 7: Creation and Identification of Mutant Bst DNA Polymerases that Include L252R Here, a reference (control) polymerase consisting of SEQ ID NO: 35 (PSP4) was compared to two mutant polymerases produced essentially according to Example 4. The first mutant polymerase, referred to as PSP4-252R, contained a single amino acid substitution at residue 252 of SEQ ID NO: 35 (L252R substitution). The second mutant polymerase, referred to as PSP4-252R++, contained three amino acid substitutions relative to SEQ ID NO: 35 (L252R, H473G and H528T substitutions). As such, the PSP4-252R++ mutant polymerase contains two histidine mutations as compared to the PSP4-252R mutant polymerase. The PSP4-252R++ mutant is SEQ ID NO: 119, and also referred to herein as the "Bst LRX" mutant recombinant polymerase.

For determining Key Signal, the nucleotide sequence AGTC was annealed to the ends of the nucleic acid templates during sample preparation. Signal strength on the Ion Torrent system was then measured when it read the AGTC sequence at the start of a sequencing reaction.

FIG. 4 shows the results of nucleic sequencing data obtained under identical sequencing conditions for the control polymerase (PSP4), the L252R mutant polymerase (PSP4-252R), and the mutant having a double histidine mutation (PSP4-252R++), where the sequencing reactions were performed as essentially described in Example 5 herein.

The presence of two additional histidine mutations resulted in significantly improved sequencing metrics as compared to either the reference polymerase (PSP4) or the PSP4-252R mutant polymerase. The sequencing metrics included measuring mean AQ20 read length, key (which is a measure of signal), perfect read length, average raw read accuracy, and true accuracy for homopolymer ACGT of 6 bp or 7 bp.

Example 8: Influence of Additional Histidine Mutations to the L252R Mutant on Read Length and Accuracy Here, the effect of the double histidine mutation in the PSP4 background (as observed in Example 7) was further evaluated. The PSP4-L252R mutant polymerase (from Example 7) lacking histidine mutations was compared to the PSP4-252R++ mutant polymerase having two histidine mutations under identical nuclei acid sequencing conditions. A further mutant polymerase was prepared, essentially according to Example 4, consisting of only one histidine mutation at residue H528T. Once the single histidine mutant polymerase was purified, all three polymerases (PSP4-252R; PSP4-252R+H528T; and PSP4-L252R +H528T +H473G) were compared in nucleic acid sequencing reactions under identical conditions, performed essentially as described in Example 3, except that the control (reference) polymerase was SEQ ID NO: 35 (PSP4).

FIG. 5 shows the results of the sequencing reactions. Having two histidine mutations, one at position 473 and one at position 528, significantly improved the sequencing metrics of PSP4-L252R+H528T+H473G as compared to the mutant polymerase lacking the two histidine mutations (PSP4-L252R). The signal to noise ratio (measured by peak signal) was also observed to substantially improve when either a single or double histidine mutation was introduced into the PSP4 polymerase (SEQ ID NO: 35). Similarly, the average AQ20 read length also improved when a double histidine mutation was employed.

Unless defined otherwise, all technical and scientific terms used herein have the same meaning as is commonly understood by one of ordinary skill in the art to which these inventions belong. All patents, patent applications, published applications, treatises and other publications referred to herein, both supra and infra, are incorporated by reference in their entirety. If a definition and/or description is explicitly or implicitly set forth herein that is contrary to or otherwise inconsistent with any definition set forth in the patents, patent applications, published applications, and other publications that are herein incorporated by reference, the definition and/or description set forth herein prevails over the definition that is incorporated by reference.

The practice of the disclosure will employ, unless otherwise indicated, conventional techniques of molecular biology, microbiology and recombinant DNA techniques, which are within the skill of the art. Such techniques are explained fully in the literature. See, for example, Sambrook, J., and Russell, D. W., 2001, Molecular Cloning: A Laboratory Manual, Third Edition; Ausubel, F. M., et al., eds., 2002, Short Protocols In Molecular Biology, Fifth Edition.

Note that not all of the activities described in the general description or the examples are required, that a portion of a specific activity may not be required, and that one or more further activities may be performed in addition to those described. Still further, the order in which activities are listed are not necessarily the order in which they are performed.

In some instances, some concepts have been described with reference to specific embodiments. However, one of ordinary skill in the art appreciates that various modifications and changes can be made without departing from the scope of the invention as set forth in the claims below. Accordingly, the specification and figures are to be regarded in an illustrative rather than a restrictive sense, and all such modifications are intended to be included within the scope of invention.

Sequences of Certain Wild-Type Bst Polymerases Disclosed Herein

```
                                             SEQ ID NO: 1
Wild-type 581 amino acid fragment of Bst DNA
polymerase
Met Ala Lys Met Ala Phe Thr Leu Ala Asp Arg Val
1               5                   10

Thr Glu Glu Met Leu Ala Asp Lys Ala Ala Leu Val
            15                  20

Val Glu Val Val Glu Glu Asn Tyr His Asp Ala Pro
25              30                  35

Ile Val Gly Ile Ala Val Val Asn Glu His Gly Arg
            40                  45

Phe Phe Leu Arg Pro Glu Thr Ala Leu Ala Asp Pro
50              55                  60

Gln Phe Val Ala Trp Leu Gly Asp Glu Thr Lys Lys
            65                  70

Lys Ser Met Phe Asp Ser Lys Arg Ala Ala Val Ala
            75                  80

Leu Lys Trp Lys Gly Ile Glu Leu Cys Gly Val Ser
85              90                  95

Phe Asp Leu Leu Leu Ala Ala Tyr Leu Leu Asp Pro
            100                 105

Ala Gln Gly Val Asp Asp Val Ala Ala Ala Ala Lys
    110                 115                 120

Met Lys Gln Tyr Glu Ala Val Arg Pro Asp Glu Ala
            125                 130

Val Tyr Gly Lys Gly Ala Lys Arg Ala Val Pro Asp
            135                 140

Glu Pro Val Leu Ala Glu His Leu Val Arg Lys Ala
145                 150                 155

Ala Ala Ile Trp Glu Leu Glu Arg Pro Phe Leu Asp
            160                 165

Glu Leu Arg Arg Asn Glu Gln Asp Arg Leu Leu Val
    170                 175                 180

Glu Leu Glu Gln Pro Leu Ser Ser Ile Leu Ala Glu
            185                 190

Met Glu Phe Ala Gly Val Lys Val Asp Thr Lys Arg
            195                 200

Leu Glu Gln Met Gly Lys Glu Leu Ala Glu Gln Leu
205                 210                 215

Gly Thr Val Glu Gln Arg Ile Tyr Glu Leu Ala Gly
            220                 225

Gln Glu Phe Asn Ile Asn Ser Pro Lys Gln Leu Gly
    230                 235                 240

Val Ile Leu Phe Glu Lys Leu Gln Leu Pro Val Leu
            245                 250

Lys Lys Thr Lys Thr Gly Tyr Ser Thr Ser Ala Asp
            255                 260

Val Leu Glu Lys Leu Ala Pro Tyr His Glu Ile Val
265                 270                 275

Glu Asn Ile Leu His Tyr Arg Gln Leu Gly Lys Leu
            280                 285

Gln Ser Thr Tyr Ile Glu Gly Leu Leu Lys Val Val
    290                 295                 300
```

-continued

Arg Pro Asp Thr Lys Lys Val His Thr Ile Phe Asn
            305                 310
Gln Ala Leu Thr Gln Thr Gly Arg Leu Ser Ser Thr
            315                 320
Glu Pro Asn Leu Gln Asn Ile Pro Ile Arg Leu Glu
325                 330                 335
Glu Gly Arg Lys Ile Arg Gln Ala Phe Val Pro Ser
            340                 345
Glu Ser Asp Trp Leu Ile Phe Ala Ala Asp Tyr Ser
            350                 355                 360
Gln Ile Glu Leu Arg Val Leu Ala His Ile Ala Glu
            365                 370
Asp Asp Asn Leu Met Glu Ala Phe Arg Arg Asp Leu
            375                 380
Asp Ile His Thr Lys Thr Ala Met Asp Ile Phe Gln
385                 390                 395
Val Ser Glu Asp Glu Val Thr Pro Asn Met Arg Arg
            400                 405
Gln Ala Lys Ala Val Asn Phe Gly Ile Val Tyr Gly
            410                 415                 420
Ile Ser Asp Tyr Gly Leu Ala Gln Asn Leu Asn Ile
                        425                 430
Ser Arg Lys Glu Ala Ala Glu Phe Ile Glu Arg Tyr
            435                 440
Phe Glu Ser Phe Pro Gly Val Lys Arg Tyr Met Glu
445                 450                 455
Asn Ile Val Gln Glu Ala Lys Gln Lys Gly Tyr Val
            460                 465
Thr Thr Leu Leu His Arg Arg Arg Tyr Leu Pro Asp
            470                 475                 480
Ile Thr Ser Arg Asn Phe Asn Val Arg Ser Phe Ala
                        485                 490
Glu Arg Met Ala Met Asn Thr Pro Ile Gln Gly Ser
            495                 500
Ala Ala Asp Ile Ile Lys Lys Ala Met Ile Asp Leu
505                 510                 515
Asn Ala Arg Leu Lys Glu Glu Arg Leu Gln Ala His
            520                 525
Leu Leu Leu Gln Val His Asp Glu Leu Ile Leu Glu
            530                 535                 540
Ala Pro Lys Glu Glu Met Glu Arg Leu Cys Arg Leu
                        545                 550
Val Pro Glu Val Met Glu Gln Ala Val Thr Leu Arg
            555                 560
Val Pro Leu Lys Val Asp Tyr His Tyr Gly Ser Thr
565                 570                 575
Trp Tyr Asp Ala Lys
            580

SEQ ID NO: 16
Wild-type full length (876 amino acid) Bst DNA polymerase
Met Lys Lys Lys Leu Val Leu Ile Asp Gly Ser Ser
1                   5                   10
Val Ala Tyr Arg Ala Phe Phe Ala Leu Pro Leu Leu
            15                  20
His Asn Asp Lys Gly Ile His Thr Asn Ala Val Tyr
            25                  30                  35
Gly Phe Thr Met Met Leu Asn Lys Ile Leu Ala Glu
                        40                  45
Glu Pro Thr His Met Leu Val Ala Phe Asp Ala
50                  55                  60
Gly Lys Thr Thr Phe Arg His Glu Ala Phe Gln Glu
                        65                  70
Tyr Lys Gly Gly Arg Gln Gln Thr Pro Pro Glu Leu
            75                  80
Ser Glu Gln Phe Pro Leu Leu Arg Glu Leu Leu Arg
            85                  90                  95
Ala Tyr Arg Ile Pro Ala Tyr Glu Leu Glu Asn Tyr
                        100                 105
Glu Ala Asp Asp Ile Ile Gly Thr Leu Ala Ala Arg
            110                 115                 120
Ala Glu Gln Glu Gly Phe Glu Val Lys Val Ile Ser
                        125                 130
Gly Asp Arg Asp Leu Thr Gln Leu Ala Ser Pro His
            135                 140
Val Thr Val Asp Ile Thr Lys Lys Gly Ile Thr Asp
145                 150                 155
Ile Glu Pro Tyr Thr Pro Glu Thr Val Arg Glu Lys
                        160                 165
Tyr Gly Leu Thr Pro Glu Gln Ile Val Asp Leu Lys
            170                 175                 180
Gly Leu Met Gly Asp Lys Ser Asp Asn Ile Pro Gly
                        185                 190
Val Pro Gly Ile Gly Glu Lys Thr Ala Val Lys Leu
            195                 200
Leu Arg Gln Phe Gly Thr Val Glu Asn Val Leu Ala
205                 210                 215
Ser Ile Asp Glu Ile Lys Gly Glu Lys Leu Lys Glu
            220                 225
Thr Leu Arg Gln His Arg Glu Met Ala Leu Leu Ser
            230                 235                 240
Lys Lys Leu Ala Ala Ile Arg Arg Asp Ala Pro Val
                        245                 250
Glu Leu Ser Leu Asp Asp Ile Ala Tyr Gln Gly Glu
            255                 260
Asp Arg Glu Lys Val Val Ala Leu Phe Lys Glu Leu
265                 270                 275
Gly Phe Gln Ser Phe Leu Glu Lys Met Glu Ser Pro
            280                 285
Ser Ser Glu Glu Lys Pro Leu Ala Lys Met Ala
            290                 295                 300
Phe Thr Leu Ala Asp Arg Val Thr Glu Met Leu
            305                 310
Ala Asp Lys Ala Ala Leu Val Val Glu Val Val Glu
            315                 320
Glu Asn Tyr His Asp Ala Pro Ile Val Gly Ile Ala
325                 330                 335
Val Val Asn Glu His Gly Arg Phe Phe Leu Arg Pro
                        340                 345

Glu Thr Ala Leu Ala Asp Pro Gln Phe Val Ala Trp
350                 355                 360
Leu Gly Asp Glu Thr Lys Lys Ser Met Phe Asp
        365                 370
Ser Lys Arg Ala Ala Val Ala Leu Lys Trp Lys Gly
    375                 380
Ile Glu Leu Cys Gly Val Ser Phe Asp Leu Leu Leu
385                 390                 395
Ala Ala Tyr Leu Leu Asp Pro Ala Gln Gly Val Asp
            400                 405
Asp Val Ala Ala Ala Lys Met Lys Gln Tyr Glu
410                 415                 420
Ala Val Arg Pro Asp Glu Ala Val Tyr Gly Lys Gly
                425                 430
Ala Lys Arg Ala Val Pro Asp Glu Pro Val Leu Ala
        435                 440
Glu His Leu Val Arg Lys Ala Ala Ile Trp Glu
445                 450                 455
Leu Glu Arg Pro Phe Leu Asp Glu Leu Arg Arg Asn
                460                 465
Glu Gln Asp Arg Leu Leu Val Glu Leu Glu Gln Pro
    470                 475                 480
Leu Ser Ser Ile Leu Ala Glu Met Glu Phe Ala Gly
                485                 490
Val Lys Val Asp Thr Lys Arg Leu Glu Gln Met Gly
        495                 500
Lys Glu Leu Ala Glu Gln Leu Gly Thr Val Glu Gln
505                 510                 515
Arg Ile Tyr Glu Leu Ala Gly Gln Glu Phe Asn Ile
            520                 525
Asn Ser Pro Lys Gln Leu Gly Val Ile Leu Phe Glu
530                 535                 540
Lys Leu Gln Leu Pro Val Leu Lys Lys Thr Lys Thr
                545                 550
Gly Tyr Ser Thr Ser Ala Asp Val Leu Glu Lys Leu
        555                 560
Ala Pro Tyr His Glu Ile Val Glu Asn Ile Leu His
565                 570                 575
Tyr Arg Gln Leu Gly Lys Leu Gln Ser Thr Tyr Ile
            580                 585
Glu Gly Leu Leu Lys Val Val Arg Pro Asp Thr Lys
            590                 595                 600
Lys Val His Thr Ile Phe Asn Gln Ala Leu Thr Gln
                605                 610
Thr Gly Arg Leu Ser Ser Thr Glu Pro Asn Leu Gln
        615                 620
Asn Ile Pro Ile Arg Leu Glu Glu Gly Arg Lys Ile
625                 630                 635
Arg Gln Ala Phe Val Pro Ser Glu Ser Asp Trp Leu
                640                 645

Ile Phe Ala Ala Asp Tyr Ser Gln Ile Glu Leu Arg
            650                 655                 660
Val Leu Ala His Ile Ala Glu Asp Asp Asn Leu Met
                665                 670
Glu Ala Phe Arg Arg Asp Leu Asp Ile His Thr Lys
            675                 680
Thr Ala Met Asp Ile Phe Gln Val Ser Glu Asp Glu
    685                 690                 695
Val Thr Pro Asn Met Arg Arg Gln Ala Lys Ala Val
                700                 705
Asn Phe Gly Ile Val Tyr Gly Ile Ser Asp Tyr Gly
            710                 715                 720
Leu Ala Gln Asn Leu Asn Ile Ser Arg Lys Glu Ala
                725                 730
Ala Glu Phe Ile Glu Arg Tyr Phe Glu Ser Phe Pro
                735                 740
Gly Val Lys Arg Tyr Met Glu Asn Ile Val Gln Glu
745                 750                 755
Ala Lys Gln Lys Gly Tyr Val Thr Thr Leu Leu His
                760                 765
Arg Arg Arg Tyr Leu Pro Asp Ile Thr Ser Arg Asn
    770                 775                 780
Phe Asn Val Arg Ser Phe Ala Glu Arg Met Ala Met
                785                 790
Asn Thr Pro Ile Gln Gly Ser Ala Ala Asp Ile Ile
                795                 800
Lys Lys Ala Met Ile Asp Leu Asn Ala Arg Leu Lys
805                 810                 815
Glu Glu Arg Leu Gln Ala His Leu Leu Leu Gln Val
                820                 825
His Asp Glu Leu Ile Leu Glu Ala Pro Lys Glu Glu
                830                 835                 840
Met Glu Arg Leu Cys Arg Leu Val Pro Glu Val Met
                845                 850
Glu Gln Ala Val Thr Leu Arg Val Pro Leu Lys Val
                855                 860
Asp Tyr His Tyr Gly Ser Thr Trp Tyr Asp Ala Lys
865                 870                 875

SEQUENCE LISTING (123 sequences)

SEQ ID NO: 1 - protein, 581 aa, Artificial Sequence
  Description of Artificial Sequence: Synthetic polypeptide
  Large fragment of wild type Bst DNA polymerase
MAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 2 - protein, 581 aa, Artificial Sequence
  Description of Artificial Sequence: Synthetic polypeptide
  Large fragment Bst DNA polymerase
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 3 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLRRRRYLPDITSRNFNVRSFAERMAMNTPIQGSAADIIKKAMIDLNARLKEERLQAALLLQVHDELILEAPKEEMERLCRLVPEVMEQAVTLRVPLKVDYRYGSTWYDAK

SEQ ID NO: 4 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYREIVENILAYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLRRRRFLPDITSRNFNVRSFAERMAMNTPIQGSAADIIKKAMIDLNARLKEERLQAALLLQVHDELILEAPKEEMERLCRLVPEVMEQAVTLRVPLKVDYRYGSTWYDAK

SEQ ID NO: 5 - protein, 6 aa, Artificial Sequence
  Description of Artificial Sequence: Synthetic peptide
  MOD_RES (2)..(2): Any naturally occurring amino acid
  MOD_RES (4)..(5): Any naturally occurring amino acid
DXSXXE

SEQ ID NO: 6 - protein, 9 aa, Artificial Sequence
  Description of Artificial Sequence: Synthetic peptide
  MOD_RES (2)..(7): Any naturally occurring amino acid
KXXXXXXYG

SEQ ID NO: 7 - protein, 4 aa, Artificial Sequence
  Description of Artificial Sequence: Synthetic peptide
VHDE

SEQ ID NO: 8 - protein, 8 aa, Artificial Sequence
  Description of Artificial Sequence: Synthetic peptide
  MOD_RES (2)..(3): Any naturally occurring amino acid
DXXSLYPS

SEQ ID NO: 9 - protein, 9 aa, Artificial Sequence
  Description of Artificial Sequence: Synthetic peptide
  MOD_RES (2)..(4): Any naturally occurring amino acid
  MOD_RES (7)..(7): Any naturally occurring amino acid
KXXXNSXYG

SEQ ID NO: 10 - protein, 6 aa, Artificial Sequence
  Description of Artificial Sequence: Synthetic peptide
YGDTDS

SEQ ID NO: 11 - protein, 6 aa, Artificial Sequence
  Description of Artificial Sequence: Synthetic peptide
  MOD_RES (2)..(5): Any naturally occurring amino acid
  MOD_RES (6)..(6): Phe or Tyr
DXXXXX

SEQ ID NO: 12 - protein, 7 aa, Artificial Sequence
  Description of Artificial Sequence: Synthetic peptide
  MOD_RES (2)..(2): Any naturally occurring amino acid
  MOD_RES (4)..(6): Any naturally occurring amino acid
  MOD_RES (7)..(7): Ser or Ala
FXGXXXX

SEQ ID NO: 13 - protein, 4 aa, Artificial Sequence
  Description of Artificial Sequence: Synthetic peptide
  MOD_RES (2)..(2): Any naturally occurring amino acid
YXDD

SEQ ID NO: 14 - protein, 9 aa, Artificial Sequence
  Description of Artificial Sequence: Synthetic peptide
  MOD_RES (2)..(8): Any naturally occurring amino acid
GXXXXXXXK

SEQ ID NO: 15 - protein, 832 aa, Artificial Sequence [sequence omitted]

SEQ ID NO: 16 - protein, 876 aa, Artificial Sequence
  Description of Artificial Sequence: Synthetic polypeptide
  Wild type Bacillus stearothermophilus DNA polymerase polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 17 - DNA, 1746 bp, Artificial Sequence
  Description of Artificial Sequence: Synthetic polynucleotide
atggcaaaaatggcatttaccctggcagatcgtgttaccgaagaaatgctggcagataaagcagcactggttgttgaagttgtggaagaaaactatcatgatgcaccgattgttggtattgccgttgttaatgaacgcggtcgtttttttctgcgtccggaaaccgcactggcagatccgcagtttgttgcatggctgggtgatgaaaccaaaaagaaaagcatgttcgacagcaaacgtgcagcagttgcactgaaatggaaaggtattgaactgtgcggtgtgtcatttgatctgctgctggcagcatatctgctggatccggcacagggtgttgatgatgttgcagcagcagcaaaaatgaaacagtatgaagcagttcgtccggatgaagcagtttatggtaaaggtgcaaaacgtgcagttccggatgaaccggttctggcagaacatctggttcgtaaagcagcagcaatttgggaactggaacgtccgtttctggatgaactgcgtcgtaatgaacaggatcgtctgctggttgaactggaacagccgctgagcagcattctggcagaaatggaatttgccggtgttaaagttgataccaaacgtctggaacaaatgggtaaagaactggccgaacaactgggcaccgttgaacagcgtatttatgaactggcaggccaagaatttaacattaatagcccgaaacagctgggcgttatcctgtttgaaaaactgcagctgccggttctgaaaaaaaccaaaaccggttatagcaccagcgcagatgttctggaaaaactggcaccgtatcatgaaattgtggaaaacattctgcactatcgtcagctgggtaaactgcagagcacctatattgaaggtctgctgaaagttgtgcgtccggataccaaaaaagtgcataccatttttaaccaggcactgacccagaccggtcgtctgagcagcaccgaaccgaatctgcagaatattccgattcgtctggaagaaggtcgtaaaattcgtcaggcatttgttccgagcgaaagcgattggctgatttttgcagcagattatagccagattgaactgcgtgttctggcacatattgccgaagatgataatctgatggaagcatttcgtcgcgatctggatattcataccaaaaccgccatggatatttttcaggttagcgaagatgaagtgaccccgaatatgcgtcgtcaggcaaaagcagttaattttggtattgtgtatggcatcagcgattatggtctggcacagaatctgaatattagccgtaaagaagcagccgaatttatcgaacgttactttcagagctttccgggtgttaaacgctatatggaaaacattgtccaagaagccaaacagaaaggttatgttaccaccctgctgcatcgtcgtcgttatctgccgcgtattaccagccgtaactttaatgttcgtagctttgcagaacgcatggcaatgaataccccgattcagggtagcgcagcagatattatcaaaaaagccatgatcgatctgaacgcacgtctgaaagaagaacgtctgcaggcacatttactgctgcaggttcatgatgaactgattctggaagcaccgaaagaagaaatggaacgtctttgtcgtctggttccggaagttatggaacaggcagttaccctgcgtgttccgctgaaagttgattatcgttatggtagcacctggtatgatgccaaataa

SEQ ID NO: 18 - protein, 606 aa, Artificial Sequence
  Description of Artificial Sequence: Synthetic polypeptide
MVISYDNYVTILDEETLKAWIAKLEKAPVFAFDTETDSLDNISANLVGLSFAIEPGVAAYIPVAHDYLDAPDQISRERALELLKPLLEDEKALKVGQNLKYDRGILANYGIELRGIAFDTMLESYILNSVAGRHDMDSLAERWLKHKTITFEEIAGKGKNQLTFNQIALEEAGRYAAEDADVTLQLHLKMWPDLQKHKGPLNVFENIEMPLVPVLSRIERNGVKIDPKVLHNHSEELTLRLAELEKKAHEIAGEEFNLSSTKQLQTILFEKQGIKPLKKTPGGAPSTSEEVLEELALDYPLPKVILEYRGLAKLKSTYTDKLPLMINPKTGRVHTSYHQAVTATGRLSSTDPNLQNIPVRNEEGRRIRQAFIAPEDYVIVSADYSQIELRIMAHLSRDKGLLTAFAEGKDIHRATAAEVFGLPLETVTSEQRRSAKAINFGLIYGMSAFGLARQLNIPRKEAQKYMDLYFERYPGVLEYMERTRAQAKEQGYVETLDGRRLYLPDIKSSNGARRAAAERAAINAPMQGTAADIIKRAMIAVDAWLQAEQPRVRMIMQVHDELVFEVHKDDVDAVAKQIHQLMENCTRLDVPLLVEVGSGENWDQAH

SEQ ID NO: 19 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVKQRIYELAGQEFNIRSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 20 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVKQRIYELAGQEFNIRSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLRRRRYLPDITSRNFNVRSFAERMAMNTPIQGSAADIIKKAMIDLNARLKEERLQAALLLQVHDELILEAPKEEMERLCRLVPEVMEQAVTLRVPLKVDYRYGSTWYDAK

SEQ ID NO: 21 - DNA, 36 bp, Artificial Sequence
  Description of Artificial Sequence: Synthetic oligonucleotide
  Oligo 221
  modified_base (34)..(34): flourescein-dT
tttttttgcaggtgacaggtttttcctgtcaccngc

SEQ ID NO: 22 - DNA, 44 bp, Artificial Sequence
  Description of Artificial Sequence: Synthetic Hairpin oligonucleotide
tttttttccctttcctttcgggtgacaggtttttcctgtcaccc

SEQ ID NO: 23 - DNA, 1740 bp, Artificial Sequence
  Description of Artificial Sequence: Synthetic polynucleotide
atggctaaaatggcttttactcttgctgatcgtgttactgaagaaatgcttgctgataaagctgctcttgttgttgaagttgttgaagaaaattatcatgatgctcctattgttggtattgctgttgttaatgaacgtggtcgtttttttcttcgtcctgaaactgctcttgctgatcctcaatttgttgcttggcttggtgatgaaactaaaaaaaaatctatgtttgattctaaacgtgctgctgttgctcttaaatggaaaggtattgaactttgtggtgtttcttttgatcttcttcttgctgcttatcttcttgatcctgctcaaggtgttgatgatgttgctgctgctgctaaaatgaaacaatatgaagctgttcgtcctgatgaagctgtttatggtaaaggtgctaaacgtgctgttcctgatgaacctgttcttgctgaacatcttgttcgtaaagctgctgctatttgggaacttgaacgtccttttcttgatgaacttcgtcgtaatgaacaagatcgtcttcttgttgaacttgaacaacctctttcttctattcttgctgaaatggaatttgctggtgttaaagttgatactaaacgtcttgaacaaatgggtaaagaacttgctgaacaacttggtactgttaaacaacgtatttatgaacttgctggtcaagaatttaatattcgttctcctaaacaacttggtgttattctttttgaaaaacttcaacttcctgttcttaaaaaaactaaaactggttattctacttctgctgatgttcttgaaaaacttgctccttatcatgaaattgttgaaaatattcttcattatcgtcaacttggtaaacttcaatctacttatattgaaggtcttcttaaagttgttcgtcctgatactaaaaaagttcatactatttttaatcaagctcttactcaaactggtcgtctttcttctactgaacctaatcttcaaaatattcctattcgtcttgaagaaggtcgtaaaattcgtcaagcttttgttccttctgaatctgattggcttatttttgctgctgattattctcaaattgaacttcgtgttcttgctcatattgctgaagatgataatcttatggaagcttttcgtcgtgatcttgatattcatactaaaactgctatggatatttttcaagtttctgaagatgaagttactcctaatatgcgtcgtcaagctaaagctgttaattttggtattgtttatggtatttctaaatatggtcttgctcaaaatcttaatatttctcgtaaagaagctgctgaatttattgaacgttattttcaatcttttcctggtgttaaacgttatatggaaaatattgttcaagaagctaaacaaaaaggttatgttactactcttcttcatcgtcgtcgttatcttcctgatattacttctcgtaattttaatgttcgttcttttgctgaacgtatggctatgaatactcctattcaaggttctgctgctgatattattaaaaaagctatgattgatcttaatgctcgtcttaaagaagaacgtcttcaagctcatcttcttcttcaagttcatgatgaacttattcttgaagctcctaaagaagaaatggaacgtctttgtcgtcttgttcctgaagttatggaacaagctgttactcttcgtgttcctcttaaagttgattatcgttatggttctacttggtatgatgct

SEQ ID NO: 24 - protein, 832 aa, Artificial Sequence
  Description of Artificial Sequence: Synthetic polypeptide
MRGMLPLFEPKGRVLLVDGHHLAYRTFHALKGLTTSRGEPVQAVYGFAKSLLKALKEDGDAVIVVFDAKAPSFRHEAYGGYKAGRAPTPEDFPRQLALIKELVDLLGLARLEVPGYEADDVLASLAKKAEKEGYEVRILTADKDLYQLLSDRIHVLHPEGYLITPAWLWEKYGLRPDQWADYRALTGDESDNLPGVKGIGEKTARKLLEEWGSLEALLKNLDRLKPAIREKILAHMDDLKLSWDLAKVRTDLPLEVDFAKRREPDRERLRAFLERLEFGSLLHEFGLLESPKALEEAPWPPPEGAFVGFVLSRKEPMWADLLALAAARGGRVHRAPEPYKALRDLKEARGLLAKDLSVLALREGLGLPPGDDPMLLAYLLDPSNTTPEGVARRYGGEWTEEAGERAALSERLFANLWGRLEGEERLLWLYREVERPLSAVLAHMEATGVRLDVAYLRALSLEVAEEIARLEAEVFRLAGHPFNLNSRDQLERVLFDELGLPAIGKTEKTGKRSTSAAVLEALREAHPIVEKILQYRELTKLKSTYIDPLPDLIHPRTGRLHTRFNQTATATGRLSSSDPNLQNIPVRTPLGQRIRRAFIAEEGWLLVALDYSQIELRVLAHLSGDENLIRVFQEGRDIHTETASWMFGVPREAVDPLMRRAAKTINFGVLYGMSAHRLSQELAIPYEEAQAFIERYFQSFPKVRAWIEKTLEEGRRRGYVETLFGRRRYVPRLEARVKSVREAAERMAFNMPVQGTAADLMKLAMVKLFPRLEEMGARMLLQVHDELVLEAPKERAEAVARLAKEVMEGVYPLAVPLEVEVGIGEDWLSAKE

SEQ ID NO: 25 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 26 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 27 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYNEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 28 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 29 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQASLLLQVHDELILEAPKEEMERLCRLVPEVMEQAVTLRVPLKVDYHYGSTWYDAK

SEQ ID NO: 30 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 31 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 32 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAAVLEKLAPYNEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFESFPGVKRYMENIVQEAKQKGYVTTLLHRRRYLPDITSRNFRVRSFARRMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 33 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 34 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAAVLEKLAPYNEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLHRRRYLPDITSRNFRVRSFARRMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 35 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 36 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 37 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 38 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGKILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 39 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMQKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 40 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNIKSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 41 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNIRSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 42 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSIKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 43 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSRKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 44 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVHQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 45 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVKQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 46 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVTQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 47 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYKTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 48 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSREPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 49 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLMKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 50 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLKKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 51 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLRKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 52 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVTNILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 53 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIKGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 54 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMRNIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 55 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAGRMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 56 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFARRMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 57 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIRRYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 58 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIYRYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 59 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERCAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 60 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTRPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 61 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFKERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 62 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPLITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 63 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPRITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 64 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQYFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 65 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFRKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 66 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEKNYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 67 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLCARLKEERLQAHLLLQVHDELILEAPKEEMERLCRLVPEVMEQAVTLRVPLKVDYHYGSTWYDAK

SEQ ID NO: 68 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLKARLKEERLQAHLLLQVHDELILEAPKEEMERLCRLVPEVMEQAVTLRVPLKVDYHYGSTWYDAK

SEQ ID NO: 69 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPRLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 70 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRRFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 71 - protein, 876 aa, Artificial Sequence; identical to SEQ ID NO: 31
  Description of Artificial Sequence: Synthetic polypeptide

SEQ ID NO: 72 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAKVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 73 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAMVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 74 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQATLLLQVHDELILEAPKEEMERLCRLVPEVMEQAVTLRVPLKVDYHYGSTWYDAK

SEQ ID NO: 75 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLGRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 76 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYHYGSTWYDAK

SEQ ID NO: 77 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLHRRRYLPDITSRNFRVRSFAERMAMNTPIQGSAADIIKKAMIDLNARLKEERLQATLLLQVHDELILEAPKEEMERLCRLVPEVMEQAVTLRVPLKVDYHYGSTWYDAK

SEQ ID NO: 78 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNEHGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFESFPGVKRYMENIVQEAKQKGYVTTLLGRRRYLPDITSRNFRVRSFAERMAMNTPIQGSAADIIKKAMIDLNARLKEERLQATLLLQVHDELILEAPKEEMERLCRLVPEVMEQAVTLRVPLKVDYHYGSTWYDAK

SEQ ID NO: 79 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGKILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 80 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMQKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 81 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNIKSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 82 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNIRSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 83 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSIKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 84 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSRKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 85 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVHQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 86 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVKQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 87 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVTQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 88 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYKTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 89 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSREPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 90 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLMKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 91 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLKKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 92 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLRKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 93 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVTNILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 94 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIKGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 95 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMRNIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 96 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAGRMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 97 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFARRMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 98 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIRRYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 99 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIYRYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 100 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERCAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 101 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTRPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 102 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFKERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 103 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPLITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 104 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEREVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 105 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQYFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 106 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFRKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 107 - protein, 581 aa, Artificial Sequence
  Description of Artificial Sequence: Synthetic polypeptide
MAKMAFTLADRVTEEMLADKAALVVEVVEKNYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 108 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLCARLKEERLQAHLLLQVHDELILEAPKEEMERLCRLVPEVMEQAVTLRVPLKVDYRYGSTWYDAK

SEQ ID NO: 109 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLKARLKEERLQAHLLLQVHDELILEAPKEEMERLCRLVPEVMEQAVTLRVPLKVDYRYGSTWYDAK

SEQ ID NO: 110 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPRLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 111 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRRFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 112 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKCERLQAHLLLQVHDELILEAPKEEMERLCRLVPEVMEQAVTLRVPLKVDYRYGSTWYDAK

SEQ ID NO: 113 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAKVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 114 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSAMVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 115 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQATLLLQVHDELILEAPKEEMERLCRLVPEVMEQAVTLRVPLKVDYRYGSTWYDAK

SEQ ID NO: 116 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLGRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 117 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 118 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQATLLLQVHDELILEAPKEEMERLCRLVPEVMEQAVTLRVPLKVDYRYGSTWYDAK

SEQ ID NO: 119 - protein, 581 aa, Artificial Sequence
  Description of Artificial Sequence: Synthetic polypeptide
MAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLGRRRYLPDITSRNFRVRSFAERMAMNTPIQGSAADIIKKAMIDLNARLKEERLQATLLLQVHDELILEAPKEEMERLCRLVPEVMEQAVTLRVPLKVDYRYGSTWYDAK

SEQ ID NO: 120 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLHRRRYLPDITSRNFRVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 121 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVRKKTKTGYSTSADVLEKLAPYHEIVENILMYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISKYGLAQNLNISRKEAAEFIERYFQSFPGVKRYMENIVQEAKQKGYVTTLLGRRRYLPDITSRNFRVRSFAERMAMNTPIQGSAADIIKKAMIDLNARLKEERLQATLLLQVHDELILEAPKEEMERLCRLVPEVMEQAVTLRVPLKVDYRYGSTWYDAK

SEQ ID NO: 122 - protein, 876 aa, Artificial Sequence
  Description of Artificial Sequence: Synthetic polypeptide
MKKKLVLIDGSSVAYRAFFALPLLHNDKGIHTNAVYGFTMMLNKILAEEEPTHMLVAFDAGKTTFRHEAFQEYKGGRQQTPPELSEQFPLLRELLRAYRIPAYELENYEADDIIGTLAARAEQEGFEVKVISGDRDLTQLASPHVTVDITKKGITDIEPYTPETVREKYGLTPEQIVDLKGLMGDKSDNIPGVPGIGEKTAVKLLRQFGTVENVLASIDEIKGEKLKETLRQHREMALLSKKLAAIRRDAPVELSLDDIAYQGEDREKVVALFKELGFQSFLEKMESPSSEEEKPLAKMAFTLADRVTEEMLADKAALVVEVVEENYHDAPIVGIAVVNERGRFFLRPETALADPQFVAWLGDETKKKSMFDSKRAAVALKWKGIELCGVSFDLLLAAYLLDPAQGVDDVAAAAKMKQYEAVRPDEAVYGKGAKRAVPDEPVLAEHLVRKAAAIWELERPFLDELRRNEQDRLLVELEQPLSSILAEMEFAGVKVDTKRLEQMGKELAEQLGTVEQRIYELAGQEFNINSPKQLGVILFEKLQLPVLKKTKTGYSTSADVLEKLAPYHEIVENILHYRQLGKLQSTYIEGLLKVVRPDTKKVHTIFNQALTQTGRLSSTEPNLQNIPIRLEEGRKIRQAFVPSESDWLIFAADYSQIELRVLAHIAEDDNLMEAFRRDLDIHTKTAMDIFQVSEDEVTPNMRRQAKAVNFGIVYGISDYGLAQNLNISRKEAAEFIERYFQSFPGVKRYMENIVQEAKQKGYVTTLLHRRRYLPDITSRNFNVRSFAERMAMNTPIQGSAADIIKKAMIDLNARLKEERLQAHLLLQVHDELILEAPKEEMERLCRLVPEVMEQAVTLRVPLKVDYRYGSTWYDAK

SEQ ID NO: 123 - protein, 6 aa, Artificial Sequence
  Description of Artificial Sequence: Synthetic 6xHis tag
HHHHHH

What is claimed is:

1. A composition comprising a recombinant DNA polymerase, wherein the recombinant DNA polymerase comprises a polypeptide segment exhibiting polymerase activity, wherein said polypeptide segment consists of the amino acid sequence of SEQ ID NO: 35, except that said polypeptide segment has
a) a single amino acid substitution selected from the group consisting of E30K, G209Q, E220H, E220T, P236I, P236R, E245R, V251R, L252R, S260K, D264M, E267M, E267K, E267R, E277T, T324R, A344Y, E442R, E442Y, E456R, D480L, A492K, E493G, M495C, N517C, N517K, and E522C,
b) amino acid substitutions L252R and H528T, or
c) amino acid substitutions L252R, H528T, and H473G,
wherein the numbering of said amino acid substitutions in the polypeptide segment is relative to SEQ ID NO: 35; and
wherein the recombinant DNA polymerase yields a lower error rate, increased signal, and/or improved accuracy when used in a sequencing by synthesis reaction where hydrogen ions are detected, as compared to a reference polymerase having the amino acid sequence of SEQ ID NO: 35.

2. The composition of claim 1, wherein the polypeptide segment has the amino acid substitutions L252R and H528T.

3. The composition of claim 2, wherein the polypeptide segment further has amino acid substitution H473G.

4. The composition of claim 3, wherein the recombinant DNA polymerase consists of the sequence of SEQ ID NO: 119.

5. The composition of claim 1, wherein at least 90% of the amino acid sequence of the recombinant DNA polymerase is from the polypeptide segment.

6. The composition of claim 5, wherein the polypeptide segment has the amino acid substitutions L252R and H528T.

7. The composition of claim 6, wherein the polypeptide segment further has amino acid substitution H473G.

8. A method for performing a polymerization reaction, comprising
(a) contacting a recombinant DNA polymerase according to claim 1 with a nucleic acid template in the presence of one or more nucleotides; and
(b) polymerizing at least one of the one or more nucleotides using the recombinant polymerase.

9. The method of claim 8, wherein the DNA polymerase is contacted with the nucleic acid template in the presence of one or more nucleotides and a salt, wherein the salt is KCl and/or NaCl, and wherein the salt concentration is from 125 mM to 175 mM.

10. A method for obtaining sequence information from a nucleic acid template, comprising:
(a) providing a reaction mixture comprising a template nucleic acid, one or more nucleotides, a sequencing primer and a recombinant polymerase according to claim 1;
(b) contacting the template nucleic acid with at least one type of nucleotide, wherein the contacting includes incorporating one or more nucleotides from the at least one type of nucleotide onto the 3' end of the sequencing primer and generating an extended primer product; and
(c) detecting the presence of the extended primer product in the reaction mixture by detecting a release of hydrogen ions, thereby determining whether nucleotide incorporation has occurred.

11. The method of claim 10, wherein the DNA polymerase is contacted with the nucleic acid template in the presence of one or more nucleotides and a salt, wherein the salt is KCl and/or NaCl, and wherein the salt is present at a concentration of between 125 mM and 175 mM.

12. The method of claim 10, wherein the recombinant DNA polymerase has the sequence of SEQ ID NO: 119.

13. The composition according to claim 1, wherein said recombinant DNA polymerase comprises the 295 amino terminal amino acids of SEQ ID NO: 120 followed by the polypeptide segment.

14. The composition of claim 13, wherein the polypeptide segment has the amino acid substitutions L252R and H528T.

15. The composition of claim 14, wherein the polypeptide segment further has amino acid substitution H473G.

16. The composition of claim 13, wherein at least 90% of the amino acids of the recombinant DNA polymerase are from the 295 amino terminal amino acids of SEQ ID NO: 120 and the polypeptide segment.

17. The composition of claim 16, wherein the polypeptide segment has the amino acid substitutions L252R and H528T.

18. The composition of claim 17, wherein the polypeptide segment further has amino acid substitution H473G.

19. A composition comprising a recombinant DNA polymerase, wherein the recombinant DNA polymerase comprises a polypeptide segment exhibiting polymerase activity, wherein said polypeptide segment consists of the amino acid sequence of SEQ ID NO: 121.

20. A method for performing a polymerization reaction, comprising:
(a) contacting a recombinant DNA polymerase according to claim 19 with a nucleic acid template in the presence of one or more nucleotides; and
(b) polymerizing at least one of the one or more nucleotides using the recombinant polymerase.

21. A method for obtaining sequence information from a nucleic acid template, comprising:
(a) providing a reaction mixture comprising a template nucleic acid, one or more nucleotides, a sequencing primer and a recombinant polymerase according to claim 19;

(b) contacting the template nucleic acid with at least one type of nucleotide, wherein the contacting includes incorporating one or more nucleotides from the at least one type of nucleotide onto the 3' end of the sequencing primer and generating an extended primer product; and
(c) detecting the presence of the extended primer product in the reaction mixture by detecting a release of hydrogen ions, thereby determining whether nucleotide incorporation has occurred.

* * * * *